(12) United States Patent
Sabeti et al.

(10) Patent No.: US 12,410,447 B2
(45) Date of Patent: Sep. 9, 2025

(54) ENGINEERED MUSCLE TARGETING COMPOSITIONS

(71) Applicants: The Broad Institute, Inc., Cambridge, MA (US); President and Fellows of Harvard College, Cambridge, MA (US); Massachusetts Institute of Technology, Cambridge, MA (US)

(72) Inventors: Pardis Sabeti, Cambridge, MA (US); Mohammadsharif Tabebordbar, Cambridge, MA (US); Simon Ye, Cambridge, MA (US)

(73) Assignees: The Broad Institute, Inc., Cambridge, MA (US); President and Fellows of Harvard College, Cambridge, MA (US); Massachusetts Institute of Technology, Cambridge, MA (US)

( * ) Notice: Subject to any disclaimer, the term of this patent is extended or adjusted under 35 U.S.C. 154(b) by 0 days.

(21) Appl. No.: 18/915,537

(22) Filed: Oct. 15, 2024

(65) Prior Publication Data
US 2025/0051800 A1    Feb. 13, 2025

Related U.S. Application Data

(63) Continuation of application No. 17/764,509, filed as application No. PCT/US2020/056133 on Oct. 16, 2020.

(60) Provisional application No. 63/055,252, filed on Jul. 22, 2020, provisional application No. 63/018,454, filed on Apr. 30, 2020, provisional application No. 62/916,207, filed on Oct. 16, 2019, provisional application No. 62/916,221, filed on Oct. 16, 2019.

(51) Int. Cl.
| | |
|---|---|
| *C12N 15/86* | (2006.01) |
| *A61K 31/7088* | (2006.01) |
| *A61K 47/64* | (2017.01) |
| *A61K 48/00* | (2006.01) |
| *C07K 7/06* | (2006.01) |
| *C07K 14/005* | (2006.01) |
| *C07K 14/47* | (2006.01) |
| *C12N 9/22* | (2006.01) |
| *C12N 15/11* | (2006.01) |
| *C12N 15/861* | (2006.01) |

(52) U.S. Cl.
CPC .......... *C12N 15/86* (2013.01); *A61K 31/7088* (2013.01); *A61K 47/6435* (2017.08); *A61K 48/0066* (2013.01); *C07K 7/06* (2013.01); *C07K 14/005* (2013.01); *C07K 14/47* (2013.01); *C12N 9/22* (2013.01); *C12N 15/11* (2013.01); *C07K 2319/01* (2013.01); *C12N 2310/20* (2017.05); *C12N 2750/14122* (2013.01); *C12N 2750/14123* (2013.01); *C12N 2750/14143* (2013.01); *C12N 2750/14145* (2013.01); *C12N 2800/80* (2013.01); *C12N 2810/405* (2013.01); *C12N 2810/6027* (2013.01); *C12N 2830/008* (2013.01)

(58) Field of Classification Search
CPC .. C07K 14/005; C07K 14/47; C07K 2319/01; C07K 7/06; C07K 14/4716
See application file for complete search history.

(56) References Cited

U.S. PATENT DOCUMENTS

| | | | |
|---|---|---|---|
| 4,797,368 | A | 1/1989 | Carter et al. |
| 5,173,414 | A | 12/1992 | Lebkowski et al. |
| 5,846,946 | A | 12/1998 | Huebner et al. |
| 6,911,199 | B2 | 6/2005 | Vigne et al. |
| 6,962,815 | B2 | 11/2005 | Bartlett |
| 7,285,381 | B1 | 10/2007 | Hallek et al. |
| 7,745,391 | B2 | 6/2010 | Mintz et al. |
| 7,749,492 | B2 | 7/2010 | Bartlett |
| 8,404,658 | B2 | 3/2013 | Hajjar et al. |
| 8,454,972 | B2 | 6/2013 | Nabel et al. |
| 8,476,418 | B2 | 7/2013 | Mueller et al. |
| 8,703,735 | B2 | 4/2014 | Iversen et al. |
| 8,771,945 | B1 | 7/2014 | Zhang |
| 8,895,308 | B1 | 11/2014 | Zhang et al. |
| 10,066,228 | B2 | 9/2018 | Schermerhorn |
| 10,076,536 | B2 | 9/2018 | Kole et al. |
| 2005/0287122 | A1 | 12/2005 | Bartlett et al. |
| 2009/0222937 | A1 | 9/2009 | Arnould et al. |
| 2009/0271881 | A1 | 10/2009 | Arnould et al. |
| 2010/0229252 | A1 | 9/2010 | Perez-Michaut |

(Continued)

FOREIGN PATENT DOCUMENTS

| | | |
|---|---|---|
| CN | 103561774 A | 2/2014 |
| CN | 107532177 A | 1/2018 |

(Continued)

OTHER PUBLICATIONS

International Preliminary Report on Patentability for PCT/US2020/056133, issued by the International Bureau of WIPO on Apr. 28, 2022.

(Continued)

*Primary Examiner* — Barry A Chestnut
(74) *Attorney, Agent, or Firm* — F. Brent Nix, Esq.; Johnson, Marcou, Isaacs & Nix, LLC; Christopher D. Southgate

(57) ABSTRACT

Described herein are targeting moieties that can be capable of specifically targeting muscle cells and can include an n-mer motif. In some embodiments, the n-mer motif contains an RGD motif. Also described herein are vector systems, particles, polypeptides that can encode and/or contain one or more targeting moieties. Also described herein are methods of delivering a cargo to a cell, such as a muscle cell, using one or more of the targeting moieties described herein.

30 Claims, 36 Drawing Sheets
Specification includes a Sequence Listing.

(56) References Cited

U.S. PATENT DOCUMENTS

| | | |
|---|---|---|
| 2011/0016540 A1 | 1/2011 | Weinstein et al. |
| 2011/0023145 A1 | 1/2011 | Weinstein et al. |
| 2011/0091441 A1 | 4/2011 | Gouble et al. |
| 2011/0182867 A1 | 7/2011 | Orkin et al. |
| 2011/0225664 A1 | 9/2011 | Smith |
| 2012/0204282 A1 | 8/2012 | Zhang |
| 2013/0145487 A1 | 6/2013 | Cedrone |
| 2014/0287983 A1 | 9/2014 | Mourich et al. |
| 2014/0315977 A1 | 10/2014 | Bestwick et al. |
| 2015/0079038 A1 | 3/2015 | Deverman et al. |
| 2015/0267202 A1 | 9/2015 | Iversen et al. |
| 2016/0251398 A1 | 9/2016 | Weller et al. |
| 2017/0051278 A1 | 2/2017 | Kole et al. |
| 2017/0130245 A1 | 5/2017 | Kotin et al. |
| 2018/0161359 A1 | 6/2018 | Mourich et al. |
| 2018/0169130 A1 | 6/2018 | Lorain et al. |
| 2018/0189244 A1 | 7/2018 | Ghafourifar et al. |
| 2018/0216111 A1 | 8/2018 | Wilton et al. |
| 2018/0271893 A1 | 9/2018 | Kole et al. |
| 2019/0015440 A1 | 1/2019 | Passini et al. |
| 2019/0054113 A1 | 2/2019 | Kaye |
| 2019/0100755 A1 | 4/2019 | Linsley et al. |
| 2019/0127424 A1 | 5/2019 | Srivastava et al. |
| 2019/0177723 A1 | 6/2019 | Dickson |
| 2019/0284555 A1 | 9/2019 | Schnell |

FOREIGN PATENT DOCUMENTS

| | | |
|---|---|---|
| CN | 109476707 A | 3/2019 |
| CN | 109897831 A | 6/2019 |
| CN | 114729384 A | 7/2022 |
| CN | 114787179 A | 7/2022 |
| WO | WO 93/24641 A2 | 12/1993 |
| WO | 00/12738 A1 | 3/2000 |
| WO | WO 0170955 A2 | 9/2001 |
| WO | WO 2013126794 A1 | 7/2013 |
| WO | WO 2013130824 A1 | 9/2013 |
| WO | WO 2013163628 A2 | 10/2013 |
| WO | WO 2015048577 A2 | 4/2014 |
| WO | WO 2014093622 A2 | 6/2014 |
| WO | WO 2015089354 A1 | 6/2015 |
| WO | 2015116568 A2 | 8/2015 |
| WO | WO 2015134812 A1 | 9/2015 |
| WO | WO 2015148670 A1 | 10/2015 |
| WO | WO 2015148860 A1 | 10/2015 |
| WO | WO 2015148863 A2 | 10/2015 |
| WO | WO 2015153789 A1 | 10/2015 |
| WO | WO 2015153791 A1 | 10/2015 |
| WO | WO 2016115543 A2 | 7/2016 |
| WO | WO 2017006283 A1 | 1/2017 |
| WO | 2017096164 A1 | 6/2017 |
| WO | WO 2017106304 A1 | 6/2017 |
| WO | WO 2017165862 A1 | 9/2017 |
| WO | WO 2018119330 A2 | 6/2018 |
| WO | 2018189244 A1 | 10/2018 |
| WO | 2019060454 A2 | 3/2019 |
| WO | WO 2019059973 A1 | 3/2019 |
| WO | WO 2019118806 A1 | 6/2019 |
| WO | 2019193119 A1 | 10/2019 |
| WO | 2019207132 A1 | 10/2019 |
| WO | WO 2019217911 A1 | 11/2019 |
| WO | WO 2020160183 A1 | 8/2020 |
| WO | 2019/050974 A1 | 3/2021 |
| WO | 2021/072197 A1 | 4/2021 |

OTHER PUBLICATIONS

International Search Report and Written Opinion, issued by the U.S. Patent Office, as International Searching Authority for PCT/US2020/056133 on Mar. 26, 2021.

Invitation to Pay Additional Fees, issued by the U.S. Patent and Trademark Office, as International Searching Authority for PCT/US2020/056133 on Jan. 11, 2021.

Adachi et al., "Creation of Liver-Detargeting AAV2-Derived Mutants Based on the Knowledge of AAV9 Capsid Functions", Molecular Therapy vol. 21, Supplement 1, S51, May 2013.

Büning et al., "Capsid Modifications for Targeting and Improving the Efficacy of AAV Vectors", Molecular Therapy: Methods & Clinical Development, vol. 12, pp. 248-265, Mar. 2019.

Choudhury et al., "In Vivo Selection Yields AAV-B1 Capsid for Central Nervous System and Muscle Gene Therapy", Molecular Therapy, vol. 24, No. 7, pp. 1247-1257, Jul. 2016.

Michelfelder et al., "Successful Expansion but Not Complete Restriction of Tropism of Adeno-Associated Virus by In Vivo Biopanning of Random Virus Display Peptide Libraries", PLoS ONE, vol. 4, Issue 4, e5122-e5122, Apr. 2009.

Perabo et al., "In Vitro Selection of Viral Vectors with Modified Tropism: The Adeno-associated Virus Display", Molecular Therapy, vol. 8, No. 1, pp. 151-157, Jul. 2003.

Tang et al., "AAV-directed muscular dystrophy gene therapy", Expert Opinion on Biological Therapy, vol. 10, Issue 3, pp. 395-408, Published online: Feb. 4, 2010.

Varadi et al., "Novel random peptide libraries displayed on AAV serotype 9 for selection of endothelial cell-directed gene transfer vectors", Gene Therapy vol. 19, pp. 800-809; Published Online: Sep. 29, 2011.

Wang et al., "The potential of adeno-associated viral vectors for gene delivery to muscle tissue", Expert Opin Drug Deliv., vol. 11, No. 3, pp. 345-364, Mar. 2014.

Yang et al., "A myocardium tropic adeno-associated virus (AAV) evolved by DNA shuffling and in vivo selection", PNAS, vol. 106, No. 10, pp. 3946-3951, Mar. 10, 2009.

Yu et al., "A muscle-targeting peptide displayed on AAV2 improves muscle tropism upon systemic delivery", Gene Ther., vol. 16, No. 8, pp. 953-962, Aug. 2009.

Unknown et al., "Third-Party Submission filed under 37 § C.F.R. 1.290 in U.S. Appl. No. 17/764,509" Jun. 27, 2023, pp. 1-133.

The Broad Institute, Inc., Notice of Rejection for Japanese Patent Application No. 2022-522782, Jan. 7, 2025, 8 pages.

The Broad Institute, Inc., Notification of Fourth Office Action for Chinese Patent Application No. 2020800849233, Feb. 10, 2025, 25 pages.

Stutika et al. (2016) J. Viral., vol. 90(3), 1278-1289.

Farris et al. (2008) Human Gene Ther., vol. 19, 14221-1427.

Pan et al., "Development and application of DNA shuffling in the directed evolution of adeno-associated virus", Chinese Science Bulletin , vol. 58, Issue 5-6: 411-418, 2013—English abstract.

Michelfelder et al. (2011) PLoS ONE, vol. 6(8), e23101.doi:10.1371/journal.pone.002310, 11 pages.

Wu et al. Journal of Virology (2000) vol. 74, No. 18, pp. 8635-8647.

The Broad Institute, Inc., "Office Action for Canadian Patent Application No. 3,148,356", Dec. 19, 2024, 4 pages.

The Broad Institute, Inc., Notice of Rejection for Japanese Patent Application No. 2022-515996, Mar. 5, 2025, 14 pages.

Alba, R., et al., "Gutless adenovirus: last-generation adenovirus for gee therapy." Gene Therapy, vol. 12, 2005, pp. S18-S27.

The Broad Institute, Inc., "Invitation to Pay Additional Fees", issued by the U.S. Patent Office as International Searching Authority for PCT/US2020/056133 on Jan. 11, 2021, 3 pages.

The Broad Institute, Inc., "International Search Report and Written Opinion for PCT/US2020/056133", issued by the United States Patent Office, as International Searching Authority on Mar. 26, 2021, 17 pages.

The Broad Institute, Inc., "Restriction Requirement", issued by U.S. Appl. No. 17/707,940, on Jun. 30, 2022, 17 pages.

The Broad Institute, Inc., "Non-Final Office Action", issued by the U.S. Patent Office in U.S. Appl. No. 17/707,940, on Oct. 20, 2022, 21 pages.

The Broad Institute, Inc., "Notice of Allowability", issued by the U.S. Patent Office in U.S. Appl. No. 17/707,940, on Feb. 6, 2023, 4 pages.

Flotte, et al. "A Phase I Study of an Adeno-Associated Virus-CFTR Gene Vector in Adult CF Patients with Mild Lung Disease." Human Gene Therapy. vol. 7, Jun. 10, 1996, pp. 1145-1159.

(56) References Cited

OTHER PUBLICATIONS

Kay, M.A., et al. "Evidence of gene transfer and expression of factor IX in haemophilia B patients treated with an AAV vector." Nature. vol. 24, Mar. 2000, pp. 257-261.
Thrasher, A.J., et al. "X-SCID transgene leukaemogenicity." Nature. vol. 44, Sep. 21, 2006, pp. E5-E6.
Woods, N., et al. "Woods et al., Reply." Nature. vol. 44, Sep. 21, 2006, pp. E6-E7.
Crane, B., et al. "Rescue administration of a helper-dependent adenovirus vector with long-term efficacy in dogs with glycogen storage disease type la." Gene Therapy, vol. 19, 2012, pp. 443-452.
West, M. H. P., et al. "Gene Expression in Adeno-Associated Virus Vectors: The Effects of Chimeric mRNA Structure, Helper Virus, and Adenovirus VAI, RNA." Virology. vol. 160, 1987, pp. 38-47.
The Broad Institute, Inc., "International Search Report and Written Opinion for PCT/US2022/076117", issued by the United States Patent Office, as International Searching Authority on Jan. 31, 2023, 14 pages.
The Broad Institute, Inc., "Invitation to Pay Additional Fees", issued by the U.S. Patent Office as International Searching Authority for PCT/US2022/076117 on Nov. 29, 2022, 2 pages.
The Broad Institute, Inc., "Invitation to Pay Additional Fees", issued by the U.S. Patent Office as International Searching Authority for PCT/US2022/076127 on Nov. 28, 2022, 3 pages.
The Broad Institute, Inc., "International Search Report and Written Opinion for PCT/US2022/076127", issued by the United States Patent Office, as International Searching Authority on Feb. 14, 2023, 51 pages.
The Broad Institute, Inc., "Invitation to Pay Additional Fees", issued by the U.S. Patent Office as International Searching Authority for PCT/US2022/074611 on Oct. 26, 2022, 3 pages.
The Broad Institute, Inc., "International Search Report and Written Opinion for PCT/US2022/074611", issued by the United States Patent Office, as International Searching Authority on Jan. 12, 2023, 16 pages.
Wang, M., et al. "Evaluation of Amphiphilic Peptide Modified Antisense Morpholino Oligonucleotides In Vitro and in Dystrophic mdx Mice." Polymers, vol. 9, 2017, pp. 1-14.
Geisler, A., and H. Fechner. "MicroRNA-regulated viral vectors for gene therapy." World J Exp Med, vol. 6, No. 2, May 20, 2016, pp. 37-54.
The Broad Institute, Inc., "Invitation to Pay Additional Fees", issued by the U.S. Patent Office as International Searching Authority for PCT/US2022/077628 on Jan. 9, 2023.
Morral, N., et al., "High Doses of a Helper-Dependent Adenoviral Vector Yield Supraphysiological Levels of alpha1-Antitrypsin with Negligible Toxicity." Human Gene Therapy, vol. 9, Dec. 10, 1998, pp. 2709-2716.
Afione, S. A., et al., "In vivo Model of Adeno-Associated Virus Vector Persistence and Rescue." Journal of Virology , vo. 70, No. 5, May 1996, pp. 3235-3241.
Mendell, J. R., et al., "Single-Dose Gene-Replacement Therapy for Spinal Muscular Atrophy." New England Journal of Medicine, vol. 377, No. 18, Nov. 2, 2017, pp. 1713-1722.
Naso, M. F., et al., "Adeno-Associated Virus (AAV) as a Vector for Gene Therapy." BioDrugs, vol. 31 (2017), pp. 317-334.
Wu, Z., et al., "Adeno-associated Virus Serotypes: Vector Toolkit for Human Gene Therapy." Molecular Therapy, vol. 14, No. 3, Sep. 2006, pp. 316-327.
Faust, S. M., et al., "CpG-depleted adeno-associated virus vectors evade immune detection." Journal of Clinical Investigation, vol. 123, Jul. 2013, pp. 2994-3001.
Hocquemiller, M., et al., "Adeno-Associated Virus-Based Gene Therapy for CNS Diseases." Human Gene Therapy, vol. 27, No. 7, pp. 478-496.
Qiao, C., et al., "Liver-specific microRNA-122 target sequences incorporated in AAV vectors efficiently inhibits transgene expression in the liver." Gene Therapy, vol. 18, No. 4, Apr. 2011, pp. 1-19.

Xiang, Z., et al., "The Effect of CpG Sequences on Capsid-Specific CD8+TCellResponses toAAVVectorGene Transfer." Molecular Therapy, vol. 28, No. 3 Mar. 2020, pp. 771-783.
Xie, J., et al., "MicroRNA-regulated, Systemically Delivered rAAV9: A Step Closer to CNS-restricted Transgene Expression." Molecular Therapy, vol. 19, No. 3, Mar. 2011, pp. 526-535.
Zincarelli, C., et al., "Analysis of AAV Serotypes 1-9 Mediated Gene Expression and Tropism in Mice After Systemic Injection." Molecular Therapy, vol. 16, No. 6, Jun. 2008, pp. 1073-1080.
Domenger and Grimm "Next-generation AAV vectors—do not judge a virus (only) by its cover." Human Molecular genetics, vo. 28, No. R1, Oct. 1, 2019, pp. R3-R14.
The Broad Institute, Inc., "International Search Report and Written Opinion", issued by the European Patent Office (EPO), as International Searching Authority for PCT/US2020/050534 on Feb. 3, 2021, 20 pages.
The Broad Institute, Inc., "Invitation to Pay Additional Fees", issued by the European Patent Office for PCT/US2020/050534 on Dec. 2, 2020, 15 pages.
Adachi, et al., "A New Recombinant Adeno-Associated Virus (AAV)-Based Random Peptide Display Library System: Infection-Defective AAVI.9-3 as a Novel Detargeted Platform for Vector Evolution", Gene Therapy and Regulation, vol. 5, No. 1, pp. 31-55, Sep. 11, 2010.
Jang, et al., "An Evolved Adeno-assciciated Viral Variant Enhances Gene Delivery and Gene Targeting in Neural Stem Cells", Molecular Therapy, vol. 19, No. 4, pp. 667-675, Apr. 4, 2011.
Wang, et al., "A Rationally Engineered Capsid Variant of AAV9 for Systemic CNS-Directed and Peripheral Tissue-Detargeted Gene Delivery in Neonates", Molecular Therapy, Methods & Clinical Development, vol. 9, pp. 234-246, Jun. 1, 2018.
Yu, et al., "A muscle-targeting peptide displayed on AAV2 improves muscle tropism on systemic delivery", Gene Therapy, vol. 16, pp. 953-962, May 28, 2009.
Zhang, et al., "Addition of Six-His-Tagged Peptide to the CTerminus of Adeno-Associated Virus VPS Does Not Affect Viral Tropism or Production", Journal of Virology, vol. 76, No. 23, pp. 12023-12031, Aug. 14, 2002.
The Broad Institute, Inc., "Patent Search Report for CN 2020800759364", Aug. 9, 2023, 8 pages.
The Broad Institute, Inc., "Notification of the First Office Action for CN 2020800759364", Aug. 9, 2023, 10 pages.
Sayroo et al., "Development of novel AAV serotype 6 based vectors with selective tropism for human cancer cells", Gene Therapy, 23, pp. 18-25, 2016.
Lee et al., "Adeno-Associated Virus (AAV) Vectors: Rational Design Strategies for Capsid Engineering", Curr Opin Biomed Eng. 7, pp. 58-63, 2018.
The Broad Institute, Inc., "Notice of Rejection for Japanese Patent Application No. 2022-515996", Aug. 9, 2024, 15 pages.
Eichoff et al., 2019, Mol. Ther. Methods Clin. Devl. 15, 211-220.
Zedechlik et al., 2020, Bioconjugate Chem. 31, 1093-1106.
Michels et al., Mol. Ther. Methods Clin. Dev. 23, 334-347, 2021.
Judd et al., Mol. Ther. Nucleic Acids 1, e54, 10 pages, 2012.
Wagner et al., 2021, Adv. Sci. 8, 2004018, 22 pages.
K. Varadi et al. "Novel random peptide libraries displayed on AAV serotype 9 for selection of endothelial cell-directed gene transfer vectors", Gene Therapy. vol. 19, No. 8, Aug. 1, 2012, pp. 800-809.
Mgne, et al., "RGD Inclusion in the Hexon Monomer Provides Adenovirus Type 5-Based Vectors with a Fiber Knob-Independent Pathway for Infection." Journal of Virology. vol. 73, No. 6, Jun. 1999, pp. 5165-5161.
Dan Wang et al. "The potential of adeno-associated viral vectors for gene delivery to muscle tissue", Expert Opinion on Drug Delivery, vol. 11, No. 3., Mar. 1, 2014, pp. 345-364.
Sourav R. Choudhury et al. "In Vivo Selection Yields AAV-B1 Capsid for Central Nervous System and Muscle Gene Therapy", Molecular Therapy, vol. 24, No. 7, Jun. 7, 2016, pp. 1247-1257.
L. Yang et al., "A myocardium tropic adeno-associated virus (AAV) evolved by DNA shuffling and in vivo selection", Proceeding sof the National Academy of Sciences, vol. 106, No. 10, Mar. 10, 2009, pp. 3946-3951.

(56) References Cited

OTHER PUBLICATIONS

Perabo L. et al., "In vitro selection of viral vectors with modified tropism: The Adeno-Associated virus display", Mol. Ther. vol. 8, No. 1, Jul. 2003, pp. 151-157.
Stefan Michelfelder et al., Successful Expansion but Not Complete Restriction of Tropism of Adeno-Associated Virus by In vivo Biopanning of Random Virus Display Peptide Libraries. PLOS ONE, vol. 4, No. 4, Apr. 9, 2009, e5122, pp. 1-13.
Adachi K. et al. "Creation of a liver-detargeting AAV2-derived mutant based on the knowledge of AAV9 capsid function." Mol. Ther., vol. 21, No. S1, abstract No. 124 May 2013, p. 1.
Tang Ying et al. "AAV-directed muscular dystrophy gene therapy", Expert Opinion on Biological Therapy vol. 10, No. 3. Mar. 1, 2010 pp. 395-408.
Dimattia et al. Structural Insight into the Unique Properties of Adeno-Associated Virus Serotype 9. J. Virology. vol. 86, No. 12, Apr. 11, 2012. pp. 6947-6958.
M. D. Weitzman and R. M. Linden. "Adeno-Associated Virus Biology". Chapter in Methods in Molecular Biology. R. O. Snyder and P. Moullier (eds.) Humana Press. Totowa NJ, USA. Jan. 1, 2011. pp. 1-23.
K. Adachi et al. "Drawing a high-resolution functional map of adeno-associated virus capsid by massively parallel sequencing". Nature Communications, vol. 5. No. 3075. Jan. 17, 2014, pp. 1-14.
S. Teramato et al. "Crisis of adenoviruses in human gene therapy." The Lancet, vol. 355, May 27, 2000 pp. 1911-1912.
C. M. Lai et al. "Adenovirus and Adeno-Associated Virus Vectors". DNA Cell Biol.vol. 21, No. 12, Jul. 6, 2004, pp. 895-913.
A.V. Cideciyan. "Vision 1 Year after Gene Therapy for Leber's Congenital Amaurosis" N. Engl J Med. Aug. 13, 2009, pp. 725-727.
F. Simonelli et al. "Gene Therapy for Leber's Congenital Amaurosis is Safe and Effective Through 1.5 Years After Vector Administration", Molecular Therapy, vol. 18, No. 3, Mar. 2010 pp. 643-650.
M.A. Croyle et al. "PEGylated helper-dependent adenoviral vectors: highly efficient vectors with an enhanced safety profile", Gene Therapy vol. 12, Jan. 13, 2005, pp. 579-587.
A. Amalfitano et al. "Production and Characterization of Improved Adenovirus Vectors with the E1, E2b, and E3 Genes Deleted", Gene Therapy, vol. 72, No. 2, Feb. 1, 1998, pp. 923-933.
N. Morral et al. "Administration of helper-dependent adenoviral vectors and sequential delivery of different vector serotype for long-term liver-directed gene transfer in baboons", PNAS, vol. 26, No. 22, Oct. 26, 1999, pp. 12816-12821.
A. Rosewell et al. "Helper-Dependent Adenoviral Vectors", J Genet Syndr Gene Ther., Suppl. 5, No. 001, Oct. 29, 2011, pp. 1-34.
Balague, C. et al. "Sustained high-level expression of full-length human factor VIII and restoration of clotting activity in hemophilic mice using a minimal adenovirus vector". Blood, vol. 95, No. 3, Feb. 1, 2000, pp. 820-828.
S. Kubo and K. Mitani et al. "A New Hybrid System Capable of Efficient Lentiviral Vector Production and Stable Gene Transfer Mediated by a Single Helper-Dependent Adenoviral Vector", Journal of Virology, vol. 77, Mar. 2003, pp. 2964-2971.
W. Zhang et al. "Hybrid Adeno-Associated Viral Vectors Utilizing Transposase-Mediated Somatic Integration for Stable Transgene Expression in Human Cells", PLOS ONE, vol. 8, No. 10, e76771, Oct. 2013, pp. 1-17.
A. L. Cooney et al. "Hybrid Nonviral/Viral Vector Systems for Improved piggyBac DNA Transposon In Vivo Delivery", Molecular Therapy, vol. 23, No. 4, Apr. 2015, pp. 667-674.
Kubo, S. et al "Adenovirus-retrovirus hybrid vectors achieve highly enhanced tumor transduction and antitumor efficacy in vivo". Mol Ther, vol. 19., No. 1, Jan. 2011. pp. 76-82.
A. Ehrhardt et al. "Somatic integration from an adenoviral hybrid vector into a hot spot in mouse liver results in persistent transgene expression levels in vivo", Mol. Ther. vol. 15, No. 1, Jan. 2007, pp. 146-156.

W. Liu et al. "Recombinant Human Foamy VirMus, a Novel Vector for Neurological Disorders Gene Therapy, Drives Production of GAD in Cultured Astrocytes", Mol. Ther. vol. 15, No. 10, Oct. 2007, pp. 1834-1841.
R. M. Kotin. "Prosepects for the Use of Adeon-Associated Virus as a Vector for Human Gene Therapy", Human Gene Therapy, vol. 5, No. 7, Jul. 1994, pp. 793-801.
N. Muzyczka. "Adeno-associated Virus (AAV) Vectors: Will they work?" J. Clin Invest. vol. 94, Oct. 1994, p. 1351.
A. Srivastava. "In vivo tissue-tropism of adeno-associated viral vectors". Curr Opin Virol. vol. 21., Dec. 2016, pp. 1-12.
D. Grimm et al. "In Vitro and In Vivo Gene Therapy Vector Evolution via Multispecies Interbreeding and Retargeting of Adeno-Associated Viruses", J. Virololgy. vol. 82, No. 12, Jun. 2008, pp. 5887-5911.
J. Tratschin et al. "Adeno-Associated Virus Vector for High-Frequency Integration, Expression, and Rescue of Genes in Mammalian Cells", Molecular and Cellular Biology, vol. 5, No. 11, Nov. 1985, pp. 3251-3260.
J. Tratschin et al. "A human parvovirus, adeno-associated virus, as a eucaryotic vector: transient expression and encapsidation of the procaryotic gene for chloramphenicol acetyltransferase.", Mol Cell Biol. vol. 4, No. 10, Oct. 1984, pp. 2072-2081.
P. L. Hermonat et al. Use of adeno-associated virus as a mammalian DNA cloning vector: Transduction of neomycin resistance into mammalian tissue culture cells Proc. Natl. Acad. Sci. USA, vol. 81, Oct. 1984, pp. 6466-6470.
R. J. Samulski et al. "Helper-free stocks of recombinant adeno-associated viruses: normal integration does not require viral gene expression", J. Virology, vol. 63, No. 9, Sep. 1989, pp. 3822-3828.
S. Q. Harper, et al. "Modular flexibility of dystrophin: Implications for gene therapy of Duchenne muscular dystrophy" Nat. Medicine. vol. 8, No. 3, Mar. 2002, pp. 253-261.
S.B. England et al. "Very mild muscular dystrophy associated with the deletion of 46% of dystrophin", Nature. vol. 343, Jan. 11, 1990, pp. 180-182.
D. J. Wells et al., "Expression of human full-length and minidystrophin in transgenic mdx mice: implications for gene therapy of Duchenne muscular dystrophy", Human Molecular Genetics, vol. 4, No. 8, Aug. 1995, pp. 1245-1250.
Salva, M.Z., et al. "Design of Tissue-specific Regulatory Cassettes for High-Level rAAV-mediated Expression in Skeletal and Cardiac Muscle" Molecular Therapy, vol. 15, No. 2, Feb. 2007, pp. 320-329.
J.R. Mendell, et al. "Gene therapy for muscular dystrophy: Lessons learned and path forward", Neuorscience Letters, vol. 527, No. 2, Oct. 11, 2012, pp. 90-99.
L. R. Rodino-Klapac et al. "Micro-dystrophin and follistatin co-delivery restores muscle function in aged DMD model" Human Molecular Genetics, vol. 22, No. 24, Dec. 15, 2013, pp. 4929-4937.
V. M. Velazquez, et al. "Effective Depletion of Pre-existing Anti-AAV Antibodies Requires Broad Immune Targeting" Molecular Therapy: Methods & Clinical Development. vol. 4, Mar. 2017, pp. 159-168.
D. M. Nelson et al. "Variable rescue of microtubule and physiological phenotypes in mdx muscle expressing different miniaturized dystrophins", Human Molecular Genetics, vol. 27, No. 12, Jun. 15, 2018, pp. 2090-2100.
Asokan, A. et al. Adeno-associated virus type 2 contains an integrin alpha5beta1 binding domain essential for viral cell entry. J Virol, vol. 80, Sep. 2006, pp. 8961-8969.
Bengtsson, N. E., et al. "Muscle-specific CRISPR/Cas9 dystrophin gene editing ameliorates pathophysiology in a mouse model for Duchenne muscular dystrophy", Nat Commun vol. 8, 14454 Feb. 14, 2017, pp. 1-10.
G. Berry and A. Asokan, "Cellular transduction mechanisms of adeno-associated viral vectors", Curr Opin Virol vol. 21, Dec. 2016 pp. 1-12.
C.L. Bell et al. "The AAV9 receptor and its modification to improve in vivo lung gene transfer in mice", J Clin Invest vol. 121, No. 6 Jun. 2011 pp. 2427-2435.
Börner, K., et al., "Pre-arrayed Pan-AAV Peptide Display Libraries for Rapid Single-Round Screening". Mol Ther 28, 1016-1032. Molecular Therapy. vol. 28, No. 4, Feb. 12, 2020, pp. 1016-1032.

(56) References Cited

OTHER PUBLICATIONS

M. Cerletti et al. "Highly efficient, functional engraftment of skeletal muscle stem cells in dystrophic muscles". Cell vol. 134 No. 1, Jul. 11, 2008, pp. 37-47.
K. Y. Chan et al. "Engineered AAVs for efficient noninvasive gene delivery to the central and peripheral nervous systems". Nat Neurosci vol. 20, No. 8, Jun. 26, 2017, pp. 1172-1179.
Tabebordbar et al., "Directed evolution of a family of AAV capsid variants enabling potent muscle-directed gene delivery across species," Cell, vol. 184, No. 19, pp. 4919-4938, Sep. 2021.
The Broad Institute, Inc., "Extended European Search Report for EP 20877004.0", Oct. 19, 2023, 10 pages.
The Broad Institute, Inc.,"third Office Action and Search Report for Chinese Patent Application No. 2020800849233", Sep. 5, 2024, 58 pages.
The Broad Institute, Inc.,"Office Action for Canadian Patent Application No. 3,153,902", Dec. 23, 2024, 4 pages.
Chan, S., et al. "Branched fibers in dystrophic mdx muscle are associated with a loss of force following lengthening contractions". Am J Physiol Cell Physiol vol. 293, Jun. 13, 2007, pp. C985-C992.
S. Childers et al."Gene therapy prolongs survival and restores function in murine and canine models of myotubular myopathy". Sci Transl Med vol. 6, No. 220ra210. Jan. 1, 2014, pp. 1-31.
D. Dalkara et al. "In vivo-directed evolution of a new adeno-associated virus for therapeutic outer retinal gene delivery from the vitreous". Sci Transl Med vol. 5, No. 189, 189ra176, Jun. 12, 2013, pp. 1-12.
R. C. Challis et al. "Widespread and targeted gene expression by systemic AAV vectors: Production, purification, and administration" bioRxiv, Jan. 19, 2018. doi: https://doi.org/10.1101/246405, pp. 1-66.
M. Davidsson et al. "A systematic capsid evolution approach performed in vivo for the design of AAV vectors with tailored properties and tropism". Proc Natl Acad Sci U S A, vol. 116, No. 52, Dec. 26, 2019, pp. 27053-27062.
B.E. Deverman Cre-dependent selection yields AAV variants for widespread gene transfer to the adult brain. Nat Biotechnol vol. 34, No. 2, Feb. 2016, pp. 1-21.
W. Ding et al. "Intracellular trafficking of adeno-associated viral vectors". Gene Ther vo. 12, No. 11, Jun. 2005, pp. 873-880.
Duan,, D. "Micro-Dystrophin Gene Therapy Goes Systemic in Duchenne Muscular Dystrophy Patients". Hum Gene Ther vol. 29, No. 7, Apr. 5, 2018, pp. 733-736.
Duan, D., "Systemic AAV Micro-dystrophin Gene Therapy for Duchenne Muscular Dystrophy". Mol Ther vol. 26, No. 10 Oct. 2018, pp. 2337-2356.
A.M. Dudek et al. An Alternate Route for Adeno-associated Virus (AAV) Entry Independent of AAV Receptor. J Virol vol. 92, No. 7, e02213-17, Apr. 1, 2018, pp. 1-15.
M. Elverman et al. "Long-term effects of systemic gene therapy in a canine model of myotubular myopathy". Muscle Nerve vol. 56, No. 5, May 22, 2017, pp. 943-953.
K.D. Farris et al. "Improved splicing of adeno-associated viral (AAV) capsid protein-supplying pre-mRNAs leads to increased recombinant AAV vector production". Hum Gene Ther vol. 19, No. 12, Dec. 19, 2008, pp. 1421-1427.
G. Gao et al. "Biology of AAV serotype vectors in liver-directed gene transfer to nonhuman primates". Mol Ther vol. 13, No. 1, Oct. 10, 2005, pp. 77-87.
J.M. Goldstein, et al. "In Situ Modification of Tissue Stem and Progenitor Cell Genomes". Cell Rep vo. 27, No. 4, Apr. 23, 2019, pp. 1254-1264 e1257.
C.H. Hakim et al. "A Five-Repeat Micro-Dystrophin Gene Ameliorated Dystrophic Phenotype in the Severe DBA/2J-mdx Model of Duchenne Muscular Dystrophy". Mol Ther Methods Clin Dev, vol. 27, No. 3, Mar. 6, 2019, pp. 216-230.
K.S. Hanlon et al."Selection of an Efficient AAV Vector for Robust CNS Transgene Expression". Mol Ther Methods Clin Dev, vol. 15, Oct. 23, 2019, pp. 320-332.
C. Hinderer et al. "Severe Toxicity in Nonhuman Primates and Piglets Following High-Dose Intravenous Administration of an Adeno-Associated Virus Vector Expressing Human SMN". Hum Gene Ther. vol. 29, No. 3 Feb. 12, 2018, pp. 285-298.
J. Hordeaux et al. "The Neurotropic Properties of AAV-PHP.B Are Limited to C57BL/6J Mice". Mol Ther, vol. 26, No. 3, Mar. 7, 2018, pp. 664-668.
Hynes R.O. "Integrins: bidirectional, allosteric signaling machines". Cell, vol. 110, No. 6, Sep. 20, 2002, pp. 673-687.
Korbelin, J., et al. Pulmonary Targeting of Adeno-associated Viral Vectors by Next-generation Sequencing-guided Screening of Random Capsid Displayed Peptide Libraries. Mol Ther vol. 24, No. 6, Jun. 2016, pp. 1050-1061.
N. Levitt et al. "Definition of an efficient synthetic poly(A) site". Genes Dev, vol. 3, Jul. 1989, 1019-1025.
C. Li and R. J. Samulski. Engineering adeno-associated virus vectors for gene therapy. Nat Rev Genet, vol. 21, No. 4, Feb. 10, 2020, pp. 255-272.
C. Li et al. "Development of Patient-specific AAV Vectors After Neutralizing Antibody Selection for Enhanced Muscle Gene Transfer", Mol. Ther. vol. 24, No. 6, Jan. 2016, pp. 53-65.
D. L. Mack, "Systemic AAV8-Mediated Gene Therapy Drives Whole-Body Correction of Myotubular Myopathy in Dogs". Mol Ther, vol. 25, No. 4, Apr. 5, 2017, pp. 839-854.
J.R. Mendell et al. "Assessment of Systemic Delivery of rAAVrh74. MHCK7.micro-dystrophin in Children With Duchenne Muscular Dystrophy", JAMA Neurology, vo. 77 No. 9, Jun. 15, 2020, pp. 1-10.
L. Morales et al. "Broader Implications of Progressive Liver Dysfunction and Lethal Sepsis in Two Boys following Systemic High-Dose AAV". Mol Ther, vol. 28, No. 8, Aug. 5, 2020, pp. 1753-1755.
D.A. Murrey et al, "Feasibility and safety of systemic rAAV9-hNAGLU delivery for treating mucopolysaccharidosis IIIB: toxicology, biodistribution, and immunological assessments in primates". Hum Gene Ther Clin Dev, vol. 25, No. 2, Jun. 2014, pp. 72-84.
C.E. Nelson et al. "In vivo genome editing improves muscle function in a mouse model of Duchenne muscular dystrophy". Science vol. 351, No. 6271, Jan. 22, 2016, pp. 403-407 (included as pp. 1-12).
M.D. Pierschbacher and E. Ruoslahti, "Cell attachment activity of fibronectin can be duplicated by small synthetic fragments of the molecule". Nature 309, 30-33.
S. Pillay et al. "An essential receptor for adeno-associated virus infection". Nature vol. 530, No. 7588, Feb. 4, 2016, pp. 108-112.
N. Pulicherla et al. Engineering liver-detargeted AAV9 vectors for cardiac and musculoskeletal gene transfer. Mol Ther, vol. 19,No. 6, Jun. 2011, pp. 1070-1078.
E. Ruoslahti. "RGD and other recognition sequences for integrins" Annu Rev Cell Dev Biol, vol. 12, 1996, pp. 697-715.
C. Summerford et al. "AlphaVbeta5 integrin: a co-receptor for adeno-associated virus type 2 infection". Nat Med vol. 5, No. 1, Jan. 1999, pp. 78-82.
M. Tabebordbar et al. "In vivo gene editing in dystrophic mouse muscle and muscle stem cells". Science vol. 351, No. 6271,Jan. 26, 2016, pp. 407-411.
L. V. Tse et al. "Structure-guided evolution of antigenically distinct adeno-associated virus variants for immune evasion". Proc Natl Acad Sci U S A vol. 114, May 30, 2017, pp. E4812-E4821.
J. Weinmann et al. "Identification of a myotropic AAV by massively parallel in vivo evaluation of barcoded capsid variants". Nat Commun vol. 11, No. 1, article 5432, Oct. 28, 2020, pp. 1-12.
Z. Wu et al. Single amino acid changes can influence titer, heparin binding, and tissue tropism in different adeno-associated virus serotypes. J Virol, vol. 80, No. 22, Nov. 2006, pp. 11393-11397.
L. Yang et al. "A myocardium tropic adeno-associated virus (AAV)evolved by DNA shuffling and in vivo selection", Proc Natl Acad Sci U S A vol. 106, No. 10, Mar. 10, 2009, pp. 3946-3951.
L. Yang and X. Xiao. "Creation of a cardiotropic adeno-associated virus: the story of viral directed evolution" Virology Journal. vol. 10, article 50, 2013, pp. 1-8.

(56) References Cited

OTHER PUBLICATIONS

C. Zincarelli et al. "Analysis of AAV serotypes 1-9 mediated gene expression and tropism in mice after systemic injection". Mol Ther, vol. 16, No. 6, Jun. 2008, pp. 1073-1080.
UniProt Acession No. A0A1P8U1E3, UniProtKB—A0A1P8U1E3 (A0A1PU1E3_9ACTN), Apr. 12, 2017 [online]. pp. 1-3.
The Broad Institute, Inc., "International Search Report and Written Opinion for PCT/US2021/0042812", issued by the United States Patent Office, as International Searching Authority on Dec. 28, 2021.
The Broad Institute, Inc., "Invitation to Pay Additional Fees", issued by the U.S. Patent Office as International Searching Authority for PCT/US2021/042812 on Oct. 19, 2021.
The Broad Institute, Inc., "Chapter I International Preliminary Report on Patentability", mailed by the International Bureau for PCT/US2021/042812 on Feb. 2, 2023.
The Broad Institute, Inc., "Restriction Requirement", issued by the U.S. Appl. No. 17/707,944, on Aug. 2, 2022.
"Third-Party Pre-issuance Submission under 37 C.F.R. §1.290", filed in U.S. Appl. No. 17/707,944, on Nov. 6, 2022. pp. 1-29.
The Broad Institute, Inc., "Non-Final Office Action", issued by the U.S. Patent Office in U.S. Appl. No. 17/707,944, on Nov. 7, 2022.
Büning, H. and A. Srivastava. "Capsid Modifications for Targeting and Improving the Efficacy of AAV Vectors." Molecular Therapy: Methods & Clinical Development, vol. 12, Mar. 2019, pp. 248-265.
The Broad Institute, Inc., "Chapter I International Preliminary Report on Patentability", mailed by the International Bureau for PCT/US2020/050534 on Mar. 24, 2022, 11 pages.
The Broad Institute, Inc., "Chapter I International Preliminary Report on Patentability", mailed by the International Bureau for PCT/US2020/056133 on Apr. 28, 2022, 12 pages.

| Mouse strain | Tissue type | First 3 amino acids | Rank |
|---|---|---|---|
| C57BL/6J | Diaphragm | RGD | 2 |
| C57BL/6J | Gastrocnemius | RGD | 2 |
| C57BL/6J | Quadriceps | RGD | 1 |
| C57BL/6J | Tibialis Anterior | RGD | 3 |
| C57BL/6J | Triceps | RGD | 12 |
| C57BL/6J | Heart | RGD | 8 |
| C57BL/6J | Liver | RGD | 245 |
| C57BL/6J | Brain | RGD | 2312 |

FIG. 20A

| Mouse strain | Tissue type | First 3 amino acids | Rank |
|---|---|---|---|
| BALB/cJ | Diaphragm | RGD | 9 |
| BALB/cJ | Gastrocnemius | RGD | 2 |
| BALB/cJ | Quadriceps | RGD | 18 |
| BALB/cJ | Tibialis Anterior | RGD | 10 |
| BALB/cJ | Triceps | RGD | 4 |
| BALB/cJ | Heart | RGD | 4 |
| BALB/cJ | Liver | RGD | 883 |
| BALB/cJ | Brain | RGD | 1266 |

FIG. 20B

| Mouse strain | Tissue type | First 3 amino acids | Rank |
|---|---|---|---|
| mdx | Diaphragm | RGD | 6 |
| mdx | Gastrocnemius | RGD | 1 |
| mdx | Quadriceps | RGD | 1 |
| mdx | Tibialis Anterior | RGD | 1 |
| mdx | Triceps | RGD | 1 |
| mdx | Heart | RGD | 25 |
| mdx | Liver | RGD | 166 |
| mdx | Brain | RGD | 1584 |

FIG. 20C

ENGINEERED MUSCLE TARGETING COMPOSITIONS

CROSS-REFERENCE TO RELATED APPLICATIONS

This application is a continuation of U.S. patent application Ser. No. 17/764,509, filed on Mar. 28, 2022, which is the U.S. National Stage Application under 35 U.S.C. § 371 of Patent Cooperation Treaty Application No.: PCT/US2020/056133, filed on Oct. 16, 2020. Patent Cooperation Treaty Application No.: PCT/US2020/056133 claims the benefit of and priority to U.S. Provisional Patent Application Nos. 62/916,207, filed on Oct. 16, 2019; entitled "Engineered Adeno-Associated Virus Capsids"; 62/916,221, filed on Oct. 16, 2019, entitled "Engineered Adeno-Associated Virus Capsids"; 63/018,454, filed on Apr. 30, 2020, entitled "Engineered Adeno-Associated Virus Capsids"; and 63/055,252, filed on Jul. 22, 2020, entitled "Engineered Muscle Targeting Compositions". The contents of the above-identified applications are hereby fully incorporated herein by reference in their entireties.

SEQUENCE LISTING

The contents of the electronic sequence listing ("BROD-5005US-CON2_ST26.xml"; size is 11,474,790 bytes and it was created on Sep. 24, 2024) is herein incorporated by reference in its entirety.

TECHNICAL FIELD

The subject matter disclosed herein is generally directed to muscle targeting compositions including, but not limited to, recombinant adeno-associated virus (AAV) vectors and systems thereof, compositions, and uses thereof.

BACKGROUND

Recombinant AAVs (rAAVs) are the most commonly used delivery vehicles for gene therapy and gene editing. Nonetheless, rAAVs that contain natural capsid variants have limited cell tropism. Indeed, rAAVs used today mainly infect the liver after systemic delivery. Further, the transduction efficiency of conventional rAAVs in other cell-types, tissues, and organs by these conventional rAAVs with natural capsid variants is limited. Therefore, AAV-mediated polynucleotide delivery for diseased that affect cells, tissues, and organs other than the liver (e.g. nervous system, skeletal muscle, and cardiac muscle) typically requires an injection of a large dose of virus (typically about $1 \times 10^{14}$ vg/kg), which often results in liver toxicity. Furthermore, because large doses are required when using conventional rAAVs, manufacturing sufficient amounts of a therapeutic rAAV needed to dose adult patients is extremely challenging. Additionally, due to differences in gene expression and physiology, mouse and primate models respond differently to viral capsids. Transduction efficiency of different virus particles varies between different species, and as a result, preclinical studies in mice often do not accurately reflect results in primates, including humans. As such, there exists a need for improved rAAVs for use in the treatment of various genetic diseases.

SUMMARY

Described in certain example embodiments herein are compositions comprising a targeting moiety effective to target a muscle cell, wherein the targeting moiety comprises an n-mer motif; and a cargo, wherein the cargo is coupled to or is otherwise associated with the targeting moiety.

In certain example embodiments, the n-mer motif comprises an RGD motif or a non-RGD n-mer motif.

In certain example embodiments, the RGD motif has a formula of $X_m RGD X_n$, wherein m is 0-4 amino acids, wherein n is 0-15 amino acids, wherein X is any amino acid, and wherein each X amino acid present is independently selected from the others from the group consisting of: any amino acid.

In certain example embodiments, the RGD motif has the formula $RGDX_n$, wherein n is 4 or 5, wherein X is any amino acid, and wherein each X amino acid present is independently selected from the others from the group consisting of: any amino acid.

In certain example embodiments, the n-mer motif is any one of SEQ ID NO: 13-50, 1277-2493, 3737-4979, 6647-8313, 8314-8502, or 8692-8889.

In certain example embodiments, the targeting moiety comprises a polypeptide, a polynucleotide, a lipid, a polymer, a sugar, or a combination thereof.

In certain example embodiments, the targeting moiety comprises a viral protein.

In certain example embodiments, the viral protein is a capsid protein.

In certain example embodiments, the viral protein is an adeno associated virus (AAV) protein.

In certain example embodiments, the n-mer motif is located between two amino acids of the viral protein such that the n-mer motif is external to a viral capsid of which the viral capsid protein is part.

In certain example embodiments, the n-mer motif is inserted between any two contiguous amino acids between amino acids 262-269, 327-332, 382-386, 452-460, 488-505, 527-539, 545-558, 581-593, 704-714, or any combination thereof in an AAV9 capsid polypeptide or in an analogous position in an AAV1, AAV2, AAV3, AAV4, AAV5, AAV6, AAV7, AAV8, AAV rh.74, or AAV rh.10 capsid polypeptide.

In certain example embodiments, the n-mer motif is inserted between amino acids 588 and 589 in an AAV9 capsid polypeptide or in an analogous position in an AAV1, AAV2, AAV3, AAV4, AAV5, AAV6, AAV7, AAV8, AAV rh.74, or AAV rh.10 capsid polypeptide.

In certain example embodiments, the composition is an engineered viral particle.

In certain example embodiments, the engineered viral particle is an engineered AAV viral particle.

In certain example embodiments, the AAV viral particle is an engineered AAV1, AAV2, AAV3, AAV4, AAV5, AAV6, AAV7, AAV8, AAV9, AAV rh.74, or AAV rh.10 viral particle.

In certain example embodiments, the cargo is capable of treating or preventing a muscle disease or disorder.

In certain example embodiments, the muscle disease or disorder is
 a. an auto immune disease;
 b. a cancer;
 c. a muscular dystrophy;
 d. a neuro-muscular disease;
 e. a sugar or glycogen storage disease;
 f. an expanded repeat disease;
 g. a dominant negative disease;
 h. a cardiomyopathy;
 i. a viral disease;
 j. a progeroid disease; or
 k. any combination thereof.

In certain example embodiments, the cargo is
a. a morpholino;
b. a peptide-linked morpholino;
c. an antisense oligonucleotide;
d. a PMO, a therapeutic transgene;
e. a polynucleotide encoding a therapeutic polypeptide or peptide;
f. a PPMO;
g. one or more peptides or polypeptides;
h. one or more polynucleotides encoding a CRISPR-Cas protein, a guide RNA, or both;
i. a ribonucleoprotein, wherein the ribonucleoprotein comprises a CRISPR-Cas system molecule;
j. a therapeutic transgene RNA, or other gene modifying or therapeutic RNA and/or protein; or
k. any combination thereof.

In certain example embodiments, the cargo is capable of inducing exon skipping in a gene.

In certain example embodiments, the cargo is capable of inducing exon skipping in a dystrophin gene.

In certain example embodiments, the cargo is a mini- or micro-dystrophin gene.

In certain example embodiments, the mini- or micro-dystrophin gene comprises spectrin-like repeats 1, 1', 2, 3, 16, 17, 20, 21, 22, 23, 24, or any combination thereof, and optionally an nNOS domain, an actin binding domain, one or more hinge regions, a dystroglycan binding domain, or any combination thereof.

In certain example embodiments, the cargo is operably coupled to a muscle specific promoter.

In certain example embodiments, the expanded repeat disease is Huntington's disease, a Myotonic Dystrophy, or Facioscapulohumeral muscular dystrophy (FSHD).

In certain example embodiments, the muscular dystrophy is Duchene muscular dystrophy, Becker Muscular dystrophy, a Limb-Girdle muscular dystrophy, an Emery Dreifuss muscular dystrophy, a myotonic dystrophy, or FSHD.

In certain example embodiments, the myotonic dystrophy is a Type 1 or a Type 2 myotonic dystrophy.

In certain example embodiments, the cardiomyopathy is dilated cardiomyopathy, hypertrophic cardiomyopathy, Duchene muscular dystrophy-associated cardiomyopathy, or Dannon disease.

In certain example embodiments, the sugar or glycogen storage disease is a MPS type III disease or Pompe disease.

In certain example embodiments, the MPS type III disease, is MPS Type IIIA, IIIB, IIIC, or IIID.

In certain example embodiments, the neuro-muscular disease is Charcot-Marie-Tooth disease or Friedreich's Ataxia.

In certain example embodiments, the composition has increased muscle cell potency, muscle cell specificity, reduced immunogenicity, or any combination thereof.

Described in certain example embodiments herein are vector systems comprising a vector comprising: one or more polynucleotides each encoding all or part of one or more targeting moieties effective to target a muscle cell, wherein each targeting moiety comprises one or more n-mer motifs, wherein each n-mer motif an RGD motif or a non-RGD n-mer motif, and wherein each polynucleotide at least encodes one or more of the one or more n-mer motifs; and optionally, a regulatory element operatively coupled to one or more of the one or more polynucleotides.

In certain example embodiments, the RGD motif has a formula of $X_mRGDX_n$, wherein m is 0-4 amino acids, wherein n is 0-15 amino acids, wherein X is any amino acid, and wherein each X amino acid present is independently selected from the others from the group consisting of: any amino acid.

In certain example embodiments, the RGD motif has the formula $RGDX_n$, wherein n is 4 or 5, wherein X is any amino acid, and wherein each X amino acid present is independently selected from the others from the group consisting of: any amino acid.

In certain example embodiments, the n-mer motif is any one of SEQ ID NO: 13-50, 1277-2493, 3737-4979, 6647-8313, 8314-8502, or 8692-8889.

In certain example embodiments, the vector system further comprises a cargo.

In certain example embodiments, the cargo is a cargo polynucleotide and is optionally coupled to one or more of the one or more polynucleotides encoding the targeting moiety, the regulatory element, or both.

In certain example embodiments, the cargo polynucleotide is present on the same vector or a different vector as the one or more polynucleotides encoding the targeting moiety.

In certain example embodiments, the vector system is capable of producing virus particles that contain the cargo.

In certain example embodiments, the vector system is capable of producing a viral capsid polypeptide comprising one or more of the targeting moieties.

In certain example embodiments, the vector system is capable of producing AAV virus particles.

In certain example embodiments, AAV viral particles are engineered AAV1, AAV2, AAV3, AAV4, AAV5, AAV6, AAV7, AAV8, AAV9, AAV rh.74, or AAV rh.10 viral particle.

In certain example embodiments, the capsid polypeptide is an engineered AAV1, AAV2, AAV3, AAV4, AAV5, AAV6, AAV7, AAV8, AAV9, AAV rh.74, AAV rh.10 capsid polypeptide.

In certain example embodiments, wherein at least one of the one or more polynucleotides encoding the n-mer motif(s) is inserted between two codons corresponding to two amino acids of the viral protein such that at least one of the n-mer motifs is external to the viral capsid.

In certain example embodiments, the two codons correspond to any two contiguous amino acids between amino acids 262-269, 327-332, 382-386, 452-460, 488-505, 527-539, 545-558, 581-593, 704-714, or any combination thereof in an AAV9 capsid polypeptide or in an analogous position in an AAV1, AAV2, AAV3, AAV4, AAV5, AAV6, AAV7, AAV8, AAV rh.74, or AAV rh.10 capsid polypeptide.

In certain example embodiments, the two codons correspond to amino acid 588 and 589 in the AAV9 capsid polynucleotide or in an analogous position in an AAV1, AAV2, AAV3, AAV4, AAV5, AAV6, AAV7, AAV8, AAV rh.74, or AAV rh.10 capsid polypeptide.

In certain example embodiments, the vector comprising the one or more polynucleotides each encoding all or part of one or more targeting moieties does not comprise splice regulatory elements.

In certain example embodiments, the vector system further comprises a polynucleotide encoding a viral rep protein.

In certain example embodiments, the viral rep protein is an AAV rep protein.

In certain example embodiments, the polynucleotide encoding the viral rep protein is on the same vector or different vector as the one or more polynucleotides each encoding all or part of one or more targeting moieties.

In certain example embodiments, the viral rep protein is operatively coupled to a regulatory element.

Described in certain example embodiments herein are polypeptides produced by expressing a vector system as described herein.

In certain example embodiments, the polypeptide is a viral polypeptide.

In certain example embodiments, the viral polypeptide is an AAV polypeptide.

Described in certain example embodiments herein are particles produced by expressing a vector system as described herein.

In certain example embodiments, the particle is a viral particle.

In certain example embodiments, the viral particle is an adeno-associated virus (AAV) particle.

In certain example embodiments, the viral particle has a muscle-specific tropism.

Described in certain example embodiments, a vector system as described herein, a polypeptide as described herein, or a particle as described herein, wherein the cargo is capable of treating or preventing a muscle disease or disorder.

In certain example embodiments, the muscle disease or disorder is
a. an auto immune disease;
b. a cancer;
c. a muscular dystrophy;
d. a neuro-muscular disease;
e. a sugar or glycogen storage disease;
f. an expanded repeat disease;
g. a dominant negative disease;
h. a cardiomyopathy;
i. a viral disease;
j. a progeroid disease; or
k. any combination thereof.

In certain example embodiments, the cargo is
a. a morpholino;
b. a peptide-linked morpholino;
c. an antisense oligonucleotide;
d. a PMO, a therapeutic transgene;
e. a polynucleotide encoding a therapeutic polypeptide or peptide;
f. a PPMO;
g. one or more peptides or polypeptides;
h. one or more polynucleotides encoding a CRISPR-Cas protein, a guide RNA, or both;
i. a ribonucleoprotein, wherein the ribonucleoprotein comprises a CRISPR-Cas system molecule;
j. a therapeutic transgene RNA, or other gene modifying or therapeutic RNA and/or protein; or
k. any combination thereof.

In certain example embodiments, the cargo is capable of inducing exon skipping in a gene.

In certain example embodiments, the cargo is capable of inducing exon skipping in a dystrophin gene.

In certain example embodiments, the cargo is a mini- or micro-dystrophin gene.

In certain example embodiments, the mini- or micro-dystrophin gene comprises spectrin-like repeats 1, 1', 2, 3, 16, 17, 20, 21, 22, 23, 24, or any combination thereof, and optionally an nNOS domain, an actin binding domain, one or more hinge regions, a dystroglycan binding domain, or any combination thereof.

In certain example embodiments, the expanded repeat disease is Huntington's disease, a Myotonic Dystrophy, or Facioscapulohumeral muscular dystrophy (FSHD).

In certain example embodiments, the muscular dystrophy is Duchene muscular dystrophy, Becker Muscular dystrophy, a Limb-Girdle muscular dystrophy, an Emery Dreifuss muscular dystrophy, a myotonic dystrophy, or FSHD.

In certain example embodiments, the myotonic dystrophy is Type 1 or Type 2.

In certain example embodiments, the cardiomyopathy is dilated cardiomyopathy, hypertrophic cardiomyopathy, DMD-associated cardiomyopathy, or Dannon disease.

In certain example embodiments, the sugar or glycogen storage disease is a MPS type III disease or Pompe disease.

In certain example embodiments, the MPS type III disease, is MPS Type IIIA, IIIB, IIIC, or IIID.

In certain example embodiments, the neuro-muscular disease is Charcot-Marie-Tooth disease or Friedreich's Ataxia.

In certain example embodiments, the polypeptide, the particle, or both have increased muscle cell potency, muscle cell specificity, reduced immunogenicity, or any combination thereof.

A cell comprising:
a. a composition as described herein;
b. a vector system as described herein;
c. a polypeptide as described herein;
d. a particle as described herein; or
e. a combination thereof.

In certain example embodiments, wherein the cell is prokaryotic.

In certain example embodiments, wherein the cell is eukaryotic.

A pharmaceutical formulation comprising:
a. a composition as described herein;
b. a vector system as described herein;
c. a polypeptide as described herein;
d. a particle as described herein;
e. a cell as described herein; or
f. a combination thereof; and
a pharmaceutically acceptable carrier.

A method comprising:
administering, to a subject in need thereof, a
a. a composition as described herein;
b. a vector system as described herein;
c. a polypeptide as described herein;
d. a particle as described herein;
e. a cell as described herein;
f. a pharmaceutical formulation as described herein; or
g. a combination thereof.

In certain example embodiments, the subject in need thereof has a muscle disease or disorder.

In certain example embodiments, the muscle disease or disorder is
a. an auto immune disease;
b. a cancer;
c. a muscular dystrophy;
d. a neuro-muscular disease;
e. a sugar or glycogen storage disease;
f. an expanded repeat disease;
g. a dominant negative disease;
h. a cardiomyopathy;
i. a viral disease;
j. a progeroid disease; or
k. any combination thereof.

In certain example embodiments, the expanded repeat disease is Huntington's disease, a Myotonic Dystrophy, or Facioscapulohumeral muscular dystrophy (FSHD).

In certain example embodiments, the muscular dystrophy is Duchene muscular dystrophy, Becker Muscular dystrophy, a Limb-Girdle muscular dystrophy, an Emery Dreifuss muscular dystrophy, a myotonic dystrophy, or FSHD.

In certain example embodiments, the myotonic dystrophy is Type 1 or Type 2.

In certain example embodiments, the cardiomyopathy is dilated cardiomyopathy, hypertrophic cardiomyopathy, DMD-associated cardiomyopathy, or Dannon disease.

In certain example embodiments, the sugar or glycogen storage disease is a MPS type III disease or Pompe disease.

In certain example embodiments, the MPS type III disease, is MPS Type IIIA, IIIB, IIIC, or IIID.

In certain example embodiments, the neuro-muscular disease is Charcot-Marie-Tooth disease or Friedreich's Ataxia.

These and other embodiments, objects, features, and advantages of the example embodiments will become apparent to those having ordinary skill in the art upon consideration of the following detailed description of illustrated example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

FIG. 8) that can be used in an AAV vector system to generate an AAV capsid variant library.

FIGS. 20A-20C show tables that can demonstrate selection in different strains of mice identifies the same variants as the top muscle-tropic hits.

Figure 1:
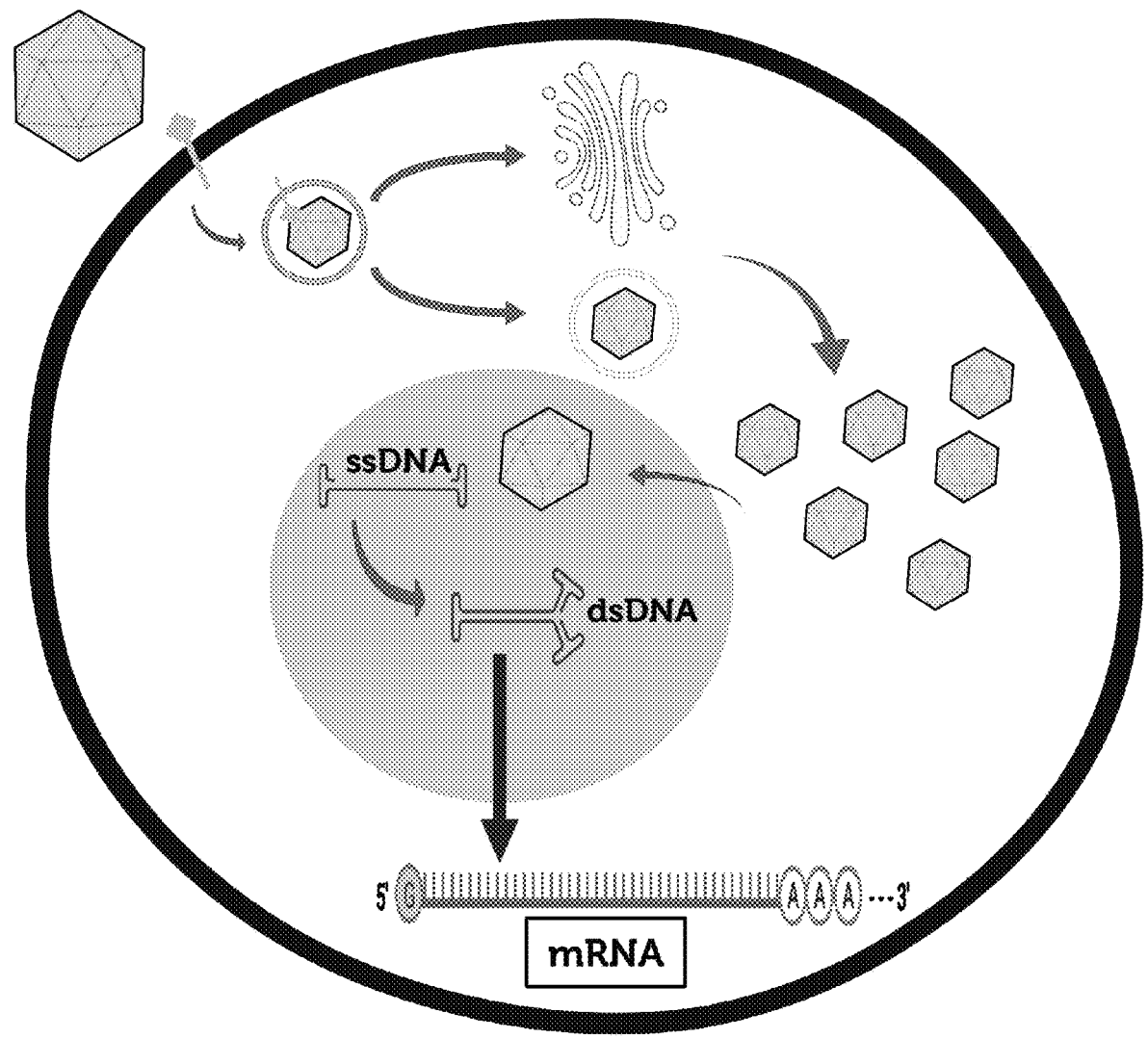
FIG. 1 demonstrates the adeno-associated virus (AAV) transduction mechanism, which results in production of mRNA from the transgene.

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratry Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology $2^{nd}$ ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints. It will be further understood that the endpoints of each of the ranges are significant both in relation to the other endpoint, and independently of the other endpoint. It is also understood that there are a number of values disclosed herein, and that each value is also herein disclosed as "about" that particular value in addition to the value itself. For example, if the value "10" is disclosed, then "about 10" is also disclosed. Ranges can be expressed herein as from "about" one particular value, and/or to "about" another particular value. Similarly, when values are expressed as approximations, by use of the antecedent "about," it will be understood that the particular value forms a further embodiment. For example, if the value "about 10" is disclosed, then "10" is also disclosed.

It is to be understood that such a range format is used for convenience and brevity, and thus, should be interpreted in a flexible manner to include not only the numerical values explicitly recited as the limits of the range, but also to include all the individual numerical values or sub-ranges encompassed within that range as if each numerical value and sub-range is explicitly recited. To illustrate, a numerical range of "about 0.1% to 5%" should be interpreted to include not only the explicitly recited values of about 0.1% to about 5%, but also include individual values (e.g., about 1%, about 2%, about 3%, and about 4%) and the sub-ranges (e.g., about 0.5% to about 1.1%; about 5% to about 2.4%; about 0.5% to about 3.2%, and about 0.5% to about 4.4%, and other possible sub-ranges) within the indicated range.

Where a range is expressed, a further embodiment includes from the one particular value and/or to the other particular value.

Where a range of values is provided, it is understood that each intervening value, to the tenth of the unit of the lower limit unless the context clearly dictates otherwise, between the upper and lower limit of that range and any other stated or intervening value in that stated range, is encompassed within the disclosure. The upper and lower limits of these smaller ranges may independently be included in the smaller ranges and are also encompassed within the disclosure, subject to any specifically excluded limit in the stated range. Where the stated range includes one or both of the limits, ranges excluding either or both of those included limits are also included in the disclosure. For example, where the stated range includes one or both of the limits, ranges excluding either or both of those included limits are also included in the disclosure, e.g. the phrase "x to y" includes the range from 'x' to 'y' as well as the range greater than 'x' and less than 'y'. The range can also be expressed as an upper limit, e.g. 'about x, y, z, or less' and should be interpreted to include the specific ranges of 'about x', 'about y', and 'about z' as well as the ranges of 'less than x', 'less than y', and 'less than z'. Likewise, the phrase 'about x, y, z, or greater' should be interpreted to include the specific ranges of 'about x', 'about y', and 'about z' as well as the ranges of 'greater than x', 'greater than y', and 'greater than z'. In addition, the phrase "about 'x' to 'y'", where 'x' and 'y' are numerical values, includes "about 'x' to about 'y'".

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed. As used herein, the terms "about," "approximate," "at or about," and "substantially" can mean that the amount or value in question can be the exact value or a value that provides equivalent results or effects as recited in the claims or taught herein. That is, it is understood that amounts, sizes, formulations, parameters, and other quantities and characteristics are not and need not be exact, but may be approximate and/or larger or smaller, as desired, reflecting tolerances, conversion factors, rounding off, measurement error and the like, and other factors known to those of skill in the art such that equivalent results or effects are obtained. In some circumstances, the value that provides equivalent results or effects cannot be reasonably determined. In general, an amount, size, formulation, parameter or other quantity or characteristic is "about," "approximate," or "at or about" whether or not expressly stated to be such. It is understood that where "about," "approximate," or "at or about" is used before a quantitative value, the parameter also includes the specific quantitative value itself, unless specifically stated otherwise.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

Various embodiments are described hereinafter. It should be noted that the specific embodiments are not intended as an exhaustive description or as a limitation to the broader embodiments discussed herein. One embodiment described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

Reference is made to U.S. Provisional Application No. 62/899,453 and International Application No. PCT/US20/50534.

All publications, published patent documents, and patent applications cited herein are hereby incorporated by reference to the same extent as though each individual publication, published patent document, or patent application was specifically and individually indicated as being incorporated by reference.

Overview

Embodiments disclosed herein provide muscle-specific targeting moieties that can be coupled to or otherwise associated with a cargo. Embodiments disclosed herein provide polypeptides and particles that can incorporate one or more of the muscle-specific targeting moieties. The polypeptides and/or particles can be coupled to, attached to, encapsulate, or otherwise incorporate a cargo, thereby associating the cargo with the targeting moiety(ies).

Embodiments disclosed herein provide muscle-specific targeting moieties that can contain one or more of an n-mer motif as further described herein, an RGD motif as further described herein, or both. In some embodiments, the n-mer motif and/or the RGD motif can confer muscle-specificity of the targeting moiety.

Embodiments disclosed herein provide engineered adeno-associated virus (AAV) capsids that can be engineered to confer cell-specific and/or species-specific tropism to an engineered AAV particle.

Embodiments disclosed herein also provide methods of generating the rAAVs having engineered capsids that can involve systematically directing the generation of diverse libraries of variants of modified surface structures, such as variant capsid proteins. Embodiments of the method of generating rAAVs having engineered capsids can also include stringent selection of capsid variants capable of targeting a specific cell, tissue, and/or organ type. Embodiments of the method of generating rAAVs having engineered capsids can include stringent selection of capsid variants capable of efficient and/or homogenous transduction in at least two or more species.

Embodiments disclosed herein provide vectors and systems thereof capable of producing an engineered AAV described herein.

Embodiments disclosed herein provide cells that can be capable of producing the engineered AAV particles described herein. In some embodiments, the cells include one or more vectors or system thereof described herein.

Embodiments disclosed herein provide engineered AAVs that can include an engineered capsid described herein. In some embodiments, the engineered AAV can include a cargo polynucleotide to be delivered to a cell. In some embodiments, the cargo polynucleotide is a gene modification polynucleotide.

Embodiments disclosed herein provide formulations that can contain an engineered AAV vector or system thereof, an engineered AAV capsid, engineered AAV particles including an engineered AAV capsid described herein, and/or an engineered cell described herein that contains an engineered AAV capsid, and/or an engineered AAV vector or system thereof. In some embodiments, the formulation can also include a pharmaceutically acceptable carrier. The formulations described herein can be delivered to a subject in need thereof or a cell.

Embodiments disclosed herein also provide kits that contain one or more of the one or more of the polypeptides, polynucleotides, vectors, engineered AAV capsids, engineered AAV particles, cells, or other components described herein and combinations thereof and pharmaceutical formulations described herein. In embodiments, one or more of the polypeptides, polynucleotides, vectors, engineered AAV capsids, engineered AAV particles cells, and combinations thereof described herein can be presented as a combination kit.

Embodiments disclosed herein provide methods of using the engineered AAVs having a cell-specific tropism described herein to deliver, for example, a therapeutic polynucleotide to a cell. In this way, the engineered AAVs described herein can be used to treat and/or prevent a disease in a subject in need thereof. Embodiments disclosed herein also provide methods of delivering the engineered AAV capsids, engineered AAV virus particles, engineered AAV vectors or systems thereof and/or formulations thereof to a cell. Also provided herein are methods of treating a subject in need thereof by delivering an engineered AAV particle, engineered AAV capsid, engineered AAV capsid vector or system thereof, an engineered cell, and/or formulation thereof to the subject.

Additional features and advantages of the embodiments engineered AAVs and methods of making and using the engineered AAVs are further described herein.

Muscle-Specific Targeting Moieties and Compositions Thereof

Described herein are targeting moieties that are capable of specifically targeting, binding, associating with, or otherwise interact specifically with a muscle cell. N-mer motifs are short peptide motifs that can confer cell and/or tissue type-targeting capabilities to another molecule, such as a cargo, to which it is incorporated, coupled to, attached, or otherwise associated with. In one example embodiment, the n-mer motif is incorporated into a viral capsid such that it is expressed on the capsid surface and confers tissue-specific targeting capability to the viral particle to facilitate tissue-specific delivery of viral particle and any optional cargo contained therein. In certain example embodiments, the n-mer motif is about 1-20 amino acids, such as 1, 2, 3, 4, 5, 6, 7, 8, 9, 10, 11, 12, 13, 14, 15, 16, 17, 18, 19, or 20 amino acids long. The term n-mer motif encompasses both n-mer motifs that have an RGD motif and those that do not (referred to herein as "non-RGD n-mer motifs"). In some example embodiments, the n-mer motif confers muscle cell/tissue specificity. In some example embodiments, the n-mer motif that confers muscle cell/tissue specificity is an RGD motif. In some example embodiments, the n-mer motif that confers muscle cell/tissue specificity is a non-RGD n-mer motif.

In some embodiments, the targeting moiety is or includes one or more n-mer motifs, where each of the one or more n-mer motifs is independently selected from an RGD motif or a non-RGD n-mer motif. N-mer motifs, RGD motifs and non-RGD n-mer motifs are described in greater detail elsewhere herein. In some embodiments, the targeting moiety includes more than one n-mer motifs, where each of the more than one n-mer motifs is independently selected from an RGD motif or a non-RGD n-mer motif. In some embodiments, the targeting moiety can include 1, 2, 3, 4, 5, 6, 7, 8, 9 10 or more n-mer motifs, where each n-mer motif is independently selected from an RGD motif or a non-RGD n-mer motif. In some embodiments, all the n-mer motifs included in the targeting moiety can be the same (i.e. have the same amino acid sequence). In some embodiments where more than one n-mer motif is included, at least two of the n-mer motifs are different from each other (i.e. have a different amino acid sequence). In some embodiments where more than one n-mer motif is included, all the n-mer motifs are different from each other. In some embodiments, each n-mer motif included in the targeting moiety can be any one of those set forth in any of Tables 1-6 and 8-9, which correspond to SEQ ID NOs: 13-50, 1277-2493, 3737-4979, 6647-8313, 8314-8502, or 8692-8889.

TABLE 1

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 1 | AGGGGTGATCTTTCTACGCCT | 60 | RGDLSTP | 1277 | 715.366 |
| 2 | AGGGGCGACCTGAACCAATAC | 61 | RGDLNQY | 1278 | 712.149 |
| 3 | CGGGGTGATCTTACTACGCCT | 62 | RGDLTTP | 1279 | 461.536 |
| 4 | AGGGGGGATGCGACGGAGCTT | 63 | RGDATEL | 1280 | 452.77 |
| 5 | CGGGGTGATCAGCTTTATCAT | 64 | RGDQLYH | 1281 | 444.505 |
| 6 | AGAGGCGACTTATCCACACCC | 65 | RGDLSTP | 1282 | 411.692 |
| 7 | CGTGGTGATGTGGCGGCTAAG | 66 | RGDVAAK | 1283 | 371.7 |
| 8 | AGAGGAGACTTGACAACCCCA | 67 | RGDLTTP | 1284 | 361.486 |
| 9 | CGGGGTGATCTTAATCAGTAT | 68 | RGDLNQY | 1285 | 342.712 |
| 10 | CGAGGAGACACCATGAGCAAA | 69 | RGDTMSK | 1286 | 325.632 |
| 11 | CGCGGAGACGTAGCCGCCAAA | 70 | RGDVAAK | 1287 | 315.01 |
| 12 | CGGGGGGATACTATGTCTAAG | 71 | RGDTMSK | 1288 | 309.567 |
| 13 | CGGGGTGACGCAACAGAATTG | 72 | RGDATEL | 1289 | 306.99 |
| 14 | GCACGGTCAAACGACTCGGTC | 73 | ARSNDSV | 1290 | 293.22 |
| 15 | CGGGGTGACATGAACAACTCA | 74 | RGDMNNS | 1291 | 268.677 |
| 16 | ACGATGGGTGCTAATGGTACT | 75 | TMGANGT | 1292 | 260.853 |
| 17 | CCTAATGTTACGCAGTCTTAT | 76 | PNVTQSY | 1293 | 259.718 |
| 18 | CGTTTGGACCTGCAAGTCCAC | 77 | RLDLQVH | 1294 | 257.65 |
| 19 | GGGCTTTCTAAGGCGTCTGAT | 78 | GLSKASD | 1295 | 255.938 |
| 20 | GATCCTGGTCGGACGGGTACG | 79 | DPGRTGT | 1296 | 253.325 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 21 | TATCGGGGTAGGGAGGATTGG | 80 | YRGREDW | 1297 | 244.83 |
| 22 | AGATACGGAGAATCCATCGAA | 81 | RYGESIE | 1298 | 231.696 |
| 23 | AGTCTGAACAACATGGGATCG | 82 | SLNNMGS | 1299 | 229.6044 |
| 24 | AATAGTGATCAGCGGAATTGG | 83 | NSDQRNW | 1300 | 229.031 |
| 25 | CGTGGTGATATGTCTCGTGAG | 84 | RGDMSRE | 1301 | 227.081 |
| 26 | ATGACTGATGCGAATAGGATT | 85 | MTDANRI | 1302 | 226.194 |
| 27 | GTCTACAACGGCAACGTAGTA | 86 | VYNGNVV | 1303 | 223.663 |
| 28 | CGTGGGGATATGATTAATACG | 87 | RGDMINT | 1304 | 223.46 |
| 29 | AGTGGTCTTTCGCATGGTCAG | 88 | SGLSHGQ | 1305 | 221.726 |
| 30 | ACTGGCCAATTAGTAGGAACC | 89 | TGQLVGT | 1306 | 221.181 |
| 31 | GCTAATTCTATTGGGGGTCCG | 90 | ANSIGGP | 1307 | 220.304 |
| 32 | TACAGTCAATCGCTGTCTGAA | 91 | YSQSLSE | 1308 | 220.02 |
| 33 | TATCATAAGTATAGTACGGAT | 92 | YHKYSTD | 1309 | 217.64 |
| 34 | GCTCGTCATGATGAGCATGTG | 93 | ARHDEHV | 1310 | 217 |
| 35 | GCCATAGACTCTATCAAACAA | 94 | AIDSIKQ | 1311 | 216.071 |
| 36 | CGTTTGGACCTGCAAGTCAAC | 95 | RLDLQVN | 1312 | 215 |
| 37 | CGCGGCGACATGATAAACACC | 96 | RGDMINT | 1313 | 214.271 |
| 38 | AGTGTGTTGTCTCAGGCTAAT | 97 | SVLSQAN | 1314 | 213.907 |
| 39 | TTTACGGTGAATCAGGATCTT | 98 | FTVNQDL | 1315 | 213.78 |
| 40 | ACGGATAATGGTCTTCTTGTG | 99 | TDNGLLV | 1316 | 211.787 |
| 41 | TATCAGCAGACTTCTAGTACG | 100 | YQQTSST | 1317 | 211.386 |
| 42 | ACAGAACAATCTTACTCACGA | 101 | TEQSYSR | 1318 | 210.762 |
| 43 | ATTATGGGGCTTAGTCAGGCT | 102 | IMGLSQA | 1319 | 208.157 |
| 44 | GCTACTGCGCATCAGGATGGT | 103 | ATAHQDG | 1320 | 207.212 |
| 45 | TATAATGCTACTCCTTCGCAG | 104 | YNATPSQ | 1321 | 206.964 |
| 46 | TATACGCAGGGTATTATGAAT | 105 | YTQGIMN | 1322 | 206.672 |
| 47 | GAATCCCTCCCAATCTCTAAA | 106 | ESLPISK | 1323 | 206.576 |
| 48 | GGCACCGTCGTTCCGGGCTCC | 107 | GTVVPGS | 1324 | 206.111 |
| 49 | GGATTAGCTAGTCTACACCTG | 108 | GLASLHL | 1325 | 204.394 |
| 50 | TATATTGCTGCGGGTGAGCAG | 109 | YIAAGEQ | 1326 | 204.24 |
| 51 | AACACCTACCCCTTCAACGCC | 110 | NTYPFNA | 1327 | 203.931 |
| 52 | GTTGGTGCGAGTACGGCTTCG | 111 | VGASTAS | 1328 | 202.92 |
| 53 | GGATCCAACTACTTAGCAAAC | 112 | GSNYLAN | 1329 | 202.857 |
| 54 | GATACTGGTCGGACGGGTACG | 113 | DTGRTGT | 1330 | 202.83 |
| 55 | AAGCCGAATACGATGAGTGAT | 114 | KPNTMSD | 1331 | 202.7282 |
| 56 | GTAGACAAATCTAGCCCAGTG | 115 | VDKSSPV | 1332 | 201.849 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 57 | AGTTCGGACCCAAAAGGTCAA | 116 | SSDPKGQ | 1333 | 201.825 |
| 58 | TGGCAGACGAATGGTATGCAG | 117 | WQTNGMQ | 1334 | 201.6943 |
| 59 | ACCGGTAGCTTGAACTCTATG | 118 | TGSLNSM | 1335 | 201.671 |
| 60 | CATTCTAATTCGAGTCAGAAT | 119 | HSNSSQN | 1336 | 200.954 |
| 61 | GGCCGTGACGACCTCACAAAC | 120 | GRDDLTN | 1337 | 200.911 |
| 62 | GATACTTATAAGGGTAAGTGG | 121 | DTYKGKW | 1338 | 200.7787 |
| 63 | TATACGGCGCAGACCGGCTGG | 122 | YTAQTGW | 1339 | 200 |
| 64 | AATCAGGTGGGTGCGTCTGCG | 123 | NQVGASA | 1340 | 200 |
| 65 | ATCGACGTACTGAACGGAAGT | 124 | IDVLNGS | 1341 | 200 |
| 66 | TTTCGGACGGTGTATACTGGT | 125 | FRTVYTG | 1342 | 200 |
| 67 | GGAAACATGGTGACTCCAAAC | 126 | GNMVTPN | 1343 | 200 |
| 68 | GATACTTATAACGGTAAGTGG | 127 | DTYNGKW | 1344 | 200 |
| 69 | ACCATCCAAGACCACATAAAA | 128 | TIQDHIK | 1345 | 200 |
| 70 | GGAGCAAAAGGAACCATGGGC | 129 | GAKGTMG | 1346 | 200 |
| 71 | ACGAGGAGCAACTCCGACGAA | 130 | TRSNSDE | 1347 | 200 |
| 72 | GCTACTACTCTTACTGGTGAT | 131 | ATTLTGD | 1348 | 200 |
| 73 | TCATACGGAGGATCTGGCCCC | 132 | SYGGSGP | 1349 | 198.715 |
| 74 | GAAAAATCCGTCGAATCCAAA | 133 | EKSVESK | 1350 | 196.418 |
| 75 | CGAGGCGACACAATGAACTAC | 134 | RGDTMNY | 1351 | 195.3082 |
| 76 | CGGGATCTGGGGCAGACCGGC | 135 | RDLGQTG | 1352 | 194.34 |
| 77 | AGTCCGCAGCTGAGTGTGATG | 136 | SPQLSVM | 1353 | 194.21 |
| 78 | CGAGGAGACAACAGCACACCG | 137 | RGDNSTP | 1354 | 193.05 |
| 79 | CCTATGGCAGGACACCCCCCG | 138 | PMAGHPP | 1355 | 192.726 |
| 80 | ACGGCGTATCAGGCTGGTCTG | 139 | TAYQAGL | 1356 | 191.778 |
| 81 | GTGGTAAACCAAGGAAACCAA | 140 | VVNQGNQ | 1357 | 191.737 |
| 82 | GATAAGACTGAGATGCTGCAG | 141 | DKTEMLQ | 1358 | 191.13 |
| 83 | ACTGTGATGATGAGTACGAGG | 142 | TVMMSTR | 1359 | 191.063 |
| 84 | CAGCAGAATACGCGTTTGCCG | 143 | QQNTRLP | 1360 | 190.1825 |
| 85 | TACCAACACAACCAAGCCCAC | 144 | YQHNQAH | 1361 | 189.595 |
| 86 | AATCAGAGTATTAATAATATT | 145 | NQSINNI | 1362 | 188.654 |
| 87 | CGAGGAGACCACAGCACACCG | 146 | RGDHSTP | 1363 | 187.365 |
| 88 | GACTCTACACTTCACTTAAGT | 147 | DSTLHLS | 1364 | 187.36 |
| 89 | GCGAACATAGAAAACACGTCA | 148 | ANIENTS | 1365 | 187.03 |
| 90 | ACAAACGCTGCTCTAGTACCA | 149 | TNAALVP | 1366 | 185.9743 |
| 91 | GGGCAGAAGGAGACTACTGCG | 150 | GQKETTA | 1367 | 184.457 |
| 92 | GAACTTAACACCGCACACGCA | 151 | ELNTAHA | 1368 | 184.059 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 93 | GGTGTTAGTAGTAATTCTGCG | 152 | GVSSNSA | 1369 | 183.964 |
| 94 | AGCACAAACGCGGGACAAAGG | 153 | STNAGQR | 1370 | 183.571 |
| 95 | GAACAACAAAAAACAGACAAC | 154 | EQQKTDN | 1371 | 182.331 |
| 96 | GCTGTTGTGAATGAGAATATG | 155 | AVVNENM | 1372 | 182.3 |
| 97 | GGCAGCGTCAGCACCAGCGCA | 156 | GSVSTSA | 1373 | 181.451 |
| 98 | GAGTTGGGTAGTCAGCGTATG | 157 | ELGSQRM | 1374 | 181.36 |
| 99 | AGAGGCGACTTATCCACACAC | 158 | RGDLSTH | 1375 | 181.15 |
| 100 | GACCACCAACAAGCCCTAGCT | 159 | DHQQALA | 1376 | 180.295 |
| 101 | AACAGATCTGACGCTCACGAA | 160 | NRSDAHE | 1377 | 180.265 |
| 102 | AATGTTAATGCGCAGAGTAGG | 161 | NVNAQSR | 1378 | 179.918 |
| 103 | ACCCAAGGGAACAACATGGTA | 162 | TQGNNMV | 1379 | 179.575 |
| 104 | ACGGCGCTGAATACGTATCCT | 163 | TALNTYP | 1380 | 179.568 |
| 105 | GTCTCTACATACCTCCTGGCA | 164 | VSTYLLA | 1381 | 179.172 |
| 106 | GGCGGCAACTACAACACAACT | 165 | GGNYNTT | 1382 | 178.62 |
| 107 | AGTAATATTAAGCCGGAGATT | 166 | SNIKPEI | 1383 | 178.567 |
| 108 | CCGAGGGTGCATGGTCAGGTT | 167 | PRVHGQV | 1384 | 178.479 |
| 109 | TCTAATTCTAATACTGCTGCT | 168 | SNSNTAA | 1385 | 178.119 |
| 110 | CTTGAGGTGGCGACGAGTCCG | 169 | LEVATSP | 1386 | 177.75 |
| 111 | CACGACGCCGACAAATTAGCT | 170 | HDADKLA | 1387 | 177.05 |
| 112 | GGTGTGTATATTGATGGTCGG | 171 | GVYIDGR | 1388 | 176.229 |
| 113 | TCGATGCAGTCGTATACGATG | 172 | SMQSYTM | 1389 | 175.538 |
| 114 | TCTAAAGGAAACGAACAAATG | 173 | SKGNEQM | 1390 | 175.311 |
| 115 | GGTCGGGATTATGCTATGAGT | 174 | GRDYAMS | 1391 | 174.17 |
| 116 | ACTGATGGTATTTTTCAGCCT | 175 | TDGIFQP | 1392 | 174.014 |
| 117 | GGGAGCCCAGTGATAGTAAAC | 176 | GSPVIVN | 1393 | 173.652 |
| 118 | ACATTAACAGACGTTCACCGA | 177 | TLTDVHR | 1394 | 172.837 |
| 119 | AAAAGCGAAGTACCCGCCCGA | 178 | KSEVPAR | 1395 | 172.72 |
| 120 | GTCAACACTGGCGCACTCTTG | 179 | VNTGALL | 1396 | 172.648 |
| 121 | AGTCAGCAGGGTTTTACTCTG | 180 | SQQGFTL | 1397 | 172.124 |
| 122 | AATAATAAGTCTGTGCCGGAT | 181 | NNKSVPD | 1398 | 172.0753 |
| 123 | AGTGTGATGGTGGGTACGAAT | 182 | SVMVGTN | 1399 | 171.86 |
| 124 | CGAAACGAAAACACTTACAAC | 183 | RNENTYN | 1400 | 170.674 |
| 125 | CAAGCTAACTTATCAATAATC | 184 | QANLSII | 1401 | 170.5862 |
| 126 | CCCGGACGGGACAGCAGAACG | 185 | PGRDSRT | 1402 | 169.875 |
| 127 | TTTCCGGCTAATGGTGGTGCT | 186 | FPANGGA | 1403 | 169.639 |
| 128 | GCTGGTAAGGATCTTAGTAAT | 187 | AGKDLSN | 1404 | 169.592 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 129 | GCACAATTCGAATCAGGCCGA | 188 | AQFESGR | 1405 | 169.281 |
| 130 | GGATACGGCAGTTACAGCAAC | 189 | GYGSYSN | 1406 | 169.247 |
| 131 | ACAATCGTTTCCGCTTACGCC | 190 | TIVSAYA | 1407 | 168.87 |
| 132 | AATGTGAGTCCTAATTTGACT | 191 | NVSPNLT | 1408 | 168.739 |
| 133 | AGAGGCGACTTATCAACACCC | 192 | RGDLSTP | 1409 | 167.66 |
| 134 | TTCTTAGAAGGAGTCGCTCAA | 193 | FLEGVAQ | 1410 | 167.647 |
| 135 | GGCTCCGAACGAGGAGAACGA | 194 | GSERGER | 1411 | 167.585 |
| 136 | TTGAATGTTGGTTCGAGTCTT | 195 | LNVGSSL | 1412 | 167.104 |
| 137 | CGTATTGTGGCTAATGAGCAG | 196 | RIVANEQ | 1413 | 166.96 |
| 138 | CAATCTATCGGCCACCCCGTT | 197 | QSIGHPV | 1414 | 166.7759 |
| 139 | GGTGGTATGTCGGCGCATTCG | 198 | GGMSAHS | 1415 | 166.775 |
| 140 | CATTCTACGACGTCTATGACG | 199 | HSTTSMT | 1416 | 166.711 |
| 141 | ACTGTAAACGGTACGAACGTA | 200 | TVNGTNV | 1417 | 166.64 |
| 142 | CTTGCGCCTGATAATATTGGG | 201 | LAPDNIG | 1418 | 166.005 |
| 143 | CAAACAGCGACTCTCGTGGCA | 202 | QTATLVA | 1419 | 165.921 |
| 144 | GCATCAGCACCGTCTGAATTC | 203 | ASAPSEF | 1420 | 165.64 |
| 145 | TCGATGGAGGGTCAGCAGCAT | 204 | SMEGQQH | 1421 | 165.62 |
| 146 | CAAGACGTAGGACGCACGAAC | 205 | QDVGRTN | 1422 | 164.147 |
| 147 | GTCTACAACGGCAACGAAGTA | 206 | VYNGNEV | 1423 | 164.11 |
| 148 | GCACAGGCGCAGACAGGCTGG | 207 | AQAQTGW | 1424 | 163.93 |
| 149 | CGGCTGGATCTGACGCATACG | 208 | RLDLTHT | 1425 | 163.75 |
| 150 | GCTGCACACGGCCGCGAACAA | 209 | AAHGREQ | 1426 | 163.577 |
| 151 | AGAGGCGACTTATACACACCC | 210 | RGDLYTP | 1427 | 163.43 |
| 152 | GGTATGCAGCAGAGGGAGAAG | 211 | GMQQREK | 1428 | 163.075 |
| 153 | CAGACTCAGGCGAGTACTAAT | 212 | QTQASTN | 1429 | 161.336 |
| 154 | CGGGACACCAACGCCCTCGGA | 213 | RDTNALG | 1430 | 161.225 |
| 155 | TCGAGTCAGATTTCTAATAGT | 214 | SSQISNS | 1431 | 161.063 |
| 156 | CAGTCGGTTAATAGTACGAGT | 215 | QSVNSTS | 1432 | 160.873 |
| 157 | GCTCTGGAGAGGGCTCAGTAT | 216 | ALERAQY | 1433 | 160.837 |
| 158 | CATACTGGGCATAGTTCTGTG | 217 | HTGHSSV | 1434 | 160.068 |
| 159 | CGGGGAGACATGACCCGAGCA | 218 | RGDMTRA | 1435 | 159.605 |
| 160 | TTTCAGCGTGATCTTGGGCAT | 219 | FQRDLGH | 1436 | 159.442 |
| 161 | ACAACCGGCGACATAATACGC | 220 | TTGDIIR | 1437 | 159.11 |
| 162 | TCTTTTCAGACGGATCGTGCG | 221 | SFQTDRA | 1438 | 159.04 |
| 163 | CAATCCAGCGACGGCCGAGTG | 222 | QSSDGRV | 1439 | 158.634 |
| 164 | ACTTCTGGGGCTTTGACCCGG | 223 | TSGALTR | 1440 | 158.32 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 165 | AATTCGAATACTGTGAATACG | 224 | NSNTVNT | 1441 | 157.71 |
| 166 | ATCTCCGGTAGTAGCAGTCTA | 225 | ISGSSSL | 1442 | 157.64 |
| 167 | AACGACAAATCAACCAACGTA | 226 | NDKSTNV | 1443 | 157.594 |
| 168 | ATCGTACTTGCTCCCACATCG | 227 | IVLAPTS | 1444 | 157.48 |
| 169 | TCAGGCGTCAACTACGGTGTC | 228 | SGVNYGV | 1445 | 157.321 |
| 170 | GTCGGCGCCCAACGGGACCCC | 229 | VGAQRDP | 1446 | 157.055 |
| 171 | ACGGGTATGAATAGTAATAAG | 230 | TGMNSNK | 1447 | 156.85 |
| 172 | ATCGAAGCCTACTCACGAGAC | 231 | IEAYSRD | 1448 | 156.774 |
| 173 | TTACACACAACACTAATGCCC | 232 | LHTTLMF | 1449 | 156.364 |
| 174 | TCTGATAATCATCTGAAGACT | 233 | SDNHLKT | 1450 | 156.334 |
| 175 | CGAAACGAAGACAAAGGAGGA | 234 | RNEDKGG | 1451 | 156.027 |
| 176 | ACGAAGGGTGCTAATGGTACT | 235 | TKGANGT | 1452 | 155.56 |
| 177 | GTCTACAACGGCAACGTAGAA | 236 | VYNGNVE | 1453 | 155.56 |
| 178 | TCAAACAGCGGAGGCAACCAC | 237 | SNSGGNH | 1454 | 155.294 |
| 179 | GTAGCCGCGGGACCAGAAGCG | 238 | VAAGPEA | 1455 | 154.25 |
| 180 | ACGTCTCTTAGTGGTAGTGCG | 239 | TSLSGSA | 1456 | 153.988 |
| 181 | GTTGGGCTGCAGAGTAATACT | 240 | VGLQSNT | 1457 | 153.453 |
| 182 | CACACCGCCCACAGCGTGGAC | 241 | HTAHSVD | 1458 | 153.3866 |
| 183 | AACGTGGGAATGAGCTCAACC | 242 | NVGMSST | 1459 | 153.212 |
| 184 | CATGCGGATGTGAATGCTGGG | 243 | HADVNAG | 1460 | 153.21 |
| 185 | AAAGCGGGACAACTAGTGGAA | 244 | KAGQLVE | 1461 | 153.178 |
| 186 | AGTACTTTTAGTGTGCTGCCT | 245 | STFSVLP | 1462 | 153.09 |
| 187 | CCTCAGTCTCCGAGTCGGGTT | 246 | PQSPSRV | 1463 | 152.823 |
| 188 | CACACCGCCACCCTTAGCAGC | 247 | HTATLSS | 1464 | 152.8 |
| 189 | CTTCCGCGTCATGATCAGTAT | 248 | LPRHDQY | 1465 | 152.412 |
| 190 | CAAGTGAACAACCCACTCACA | 249 | QVNNPLT | 1466 | 151.574 |
| 191 | ACAACAGAAACCGCACGAGGT | 250 | TTETARG | 1467 | 151.4255 |
| 192 | GTTCATGGGACGTTGACTTAT | 251 | VHGTLTY | 1468 | 150.654 |
| 193 | TATAGTACTGATCTTAGGATG | 252 | YSTDLRM | 1469 | 150.626 |
| 194 | GCACACGCTACCTCAAGCACT | 253 | AHATSST | 1470 | 150.587 |
| 195 | AGGGAGAGTGCTGCTCTGGCG | 254 | RESAALA | 1471 | 150.506 |
| 196 | AAGGATACTAATCAGCAGATT | 255 | KDTNQQI | 1472 | 150.189 |
| 197 | AGTATGCAATCATACACCATG | 256 | SMQSYTM | 1473 | 148.994 |
| 198 | ACAGCCTACTCGCCCACAGTC | 257 | TAYSPTV | 1474 | 148.946 |
| 199 | GAATCTGCCCACCAAAGAATA | 258 | ESAHQRI | 1475 | 148.867 |
| 200 | AGATACACAACAGCACAACAA | 259 | RYTTAQQ | 1476 | 148.802 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 201 | ACGTCTGTGGCGAATGTGAGT | 260 | TSVANVS | 1477 | 148.731 |
| 202 | AGGGATCAGCATACTTCTATT | 261 | RDQHTSI | 1478 | 148.687 |
| 203 | TCTGTTACGTCTTCTGGTCCG | 262 | SVTSSGP | 1479 | 148.574 |
| 204 | GCGGTTGTTCTGAATAGTAAT | 263 | AVVLNSN | 1480 | 148.476 |
| 205 | CCTGGGAATCCGTCTAGTAAT | 264 | PGNPSSN | 1481 | 147.792 |
| 206 | ACGGGGTCTACTACTCAGCTT | 265 | TGSTTQL | 1482 | 147.767 |
| 207 | GCTAATGAGCATAATGTGGGT | 266 | ANEHNVG | 1483 | 147.569 |
| 208 | ATGCAAAGAGAAGCAGCCAAC | 267 | MQREAAN | 1484 | 147.562 |
| 209 | TTAACCGACACAAACACCCGG | 268 | LTDTNTR | 1485 | 147.306 |
| 210 | CGAATGACCGAAATATCATAC | 269 | RMTEISY | 1486 | 146.933 |
| 211 | AAAGTGGACATGACCTCCAAA | 270 | KVDMTSK | 1487 | 146.392 |
| 212 | AGAGGAGACTTATCCACACCC | 271 | RGDLSTP | 1488 | 146.3 |
| 213 | CAAGCAAAAGCTAGCACAACT | 272 | QAKASTT | 1489 | 146.214 |
| 214 | CTACCCTCAACAGAAACTTTG | 273 | LPSTETL | 1490 | 145.892 |
| 215 | AGTAGTGCGCTTAATGCGTAT | 274 | SSALNAY | 1491 | 145.667 |
| 216 | TCGTCTGATCCTAAGGGGCAG | 275 | SSDPKGQ | 1492 | 145.644 |
| 217 | TTAGACGTGACGAGAATGAGA | 276 | LDVTRMR | 1493 | 145.51 |
| 218 | GCGGATGGTGGTGATAAGGGG | 277 | ADGGDKG | 1494 | 145.45 |
| 219 | ATGCTGTCTCAGGTTACGTTG | 278 | MLSQVTL | 1495 | 145.32 |
| 220 | AGTGTTAGTTCTGTGGTGTTG | 279 | SVSSVVL | 1496 | 145.202 |
| 221 | ACCGAATCGCAAACCATGAGG | 280 | TESQTMR | 1497 | 145.0149 |
| 222 | TTCGGATCCCAAGAAAAACTC | 281 | FGSQEKL | 1498 | 144.467 |
| 223 | ACAGCCGGCGGCGAACGCGCC | 282 | TAGGERA | 1499 | 144.445 |
| 224 | GATCATAGTAAGCAGAGTTCG | 283 | DHSKQSS | 1500 | 144.0179 |
| 225 | ATTGATAGTACTTGGAATACG | 284 | IDSTWNT | 1501 | 143.92 |
| 226 | TCGCCTCGCCCCGAACTCCGA | 285 | SPRPELR | 1502 | 143.362 |
| 227 | AGTATTGCGACTGCTACTAGT | 286 | SIATATS | 1503 | 143.312 |
| 228 | GTAATAGGCGGACACGGGACT | 287 | VIGGHGT | 1504 | 143.136 |
| 229 | AGCACCGCCATGTACCCCCAC | 288 | STAMYPH | 1505 | 142.798 |
| 230 | CGGGACTTGAGACCCGTGACG | 289 | RDLRPVT | 1506 | 142.461 |
| 231 | GCTCATCTGACTGATCTTCCG | 290 | AHLTDLP | 1507 | 142.37 |
| 232 | TTTCTGAATAGTACGCAGCTT | 291 | FLNSTQL | 1508 | 142.276 |
| 233 | TTAAACAACAGTGCCACAGTC | 292 | LNNSATV | 1509 | 142.021 |
| 234 | GATCGTCCGAATAATATGACG | 293 | DRPNNMT | 1510 | 141.945 |
| 235 | TCATCGTCAGACTCACCCAGA | 294 | SSSDSPR | 1511 | 141.849 |
| 236 | CGCTTGGACGTTGGAAGCCCG | 295 | RLDVGSP | 1512 | 141.82 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 237 | GCGCAGCAGAGTCTTCATGGT | 296 | AQQSLHG | 1513 | 141.401 |
| 238 | ATGGGGAAGCATGAGGGTCTT | 297 | MGKHEGL | 1514 | 141.2916 |
| 239 | GAGAATGCTCGTGAGGGTGTG | 298 | ENAREGV | 1515 | 140.87 |
| 240 | ACCGTATCTCTCTCGGAAGGC | 299 | TVSLSEG | 1516 | 140.529 |
| 241 | CTTAACACACTAATCGACCGG | 300 | LNTLIDR | 1517 | 140.256 |
| 242 | GAACTCTCCGTTCCGAAACCA | 301 | ELSVPKP | 1518 | 140.203 |
| 243 | AAAGACAAAAACGTATACATA | 302 | KDKNVYI | 1519 | 140.171 |
| 244 | AATGCGAATGGGCCTGTGAGT | 303 | NANGPVS | 1520 | 140.158 |
| 245 | CTTACTACGAATGGTATGCTG | 304 | LTTNGML | 1521 | 140.147 |
| 246 | GCCGGCGAATCTTCACCCACA | 305 | AGESSPT | 1522 | 139.95 |
| 247 | AGTGGGATTGGTACTTATTCT | 306 | SGIGTYS | 1523 | 139.76 |
| 248 | GTCAGATCTATGGACGAATTG | 307 | VRSMDEL | 1524 | 139.74 |
| 249 | ATGAACACCGGCTCTTCGAGT | 308 | MNTGSSS | 1525 | 139.328 |
| 250 | GGGGTGACTGTTAGGGAGCTT | 309 | GVTVREL | 1526 | 139.099 |
| 251 | CAGATTTTGAATTATAGTGTG | 310 | QILNYSV | 1527 | 138.991 |
| 252 | ATGGCGGGTGAGTATAGGGTT | 311 | MAGEYRV | 1528 | 138.933 |
| 253 | TGGTCGCATGATCGGCCTACT | 312 | WSHDRPT | 1529 | 138.703 |
| 254 | TGCAAAAACAACTCAGAATGC | 313 | CKNNSEC | 1530 | 138.668 |
| 255 | TTGACGACGAATAGTCATTAT | 314 | LTTNSHY | 1531 | 138.525 |
| 256 | ATGCTTGTTCAGAATACTCCT | 315 | MLVQNTP | 1532 | 138.3 |
| 257 | CGTGGTGCGACTGAGCATGCG | 316 | RGATEHA | 1533 | 138.186 |
| 258 | GCTTCGAATGGGAGTATGGGT | 317 | ASNGSMG | 1534 | 138.1181 |
| 259 | AATAGTTATACTGCTGGGAAG | 318 | NSYTAGK | 1535 | 137.4033 |
| 260 | TCCACCCAAGGAGCCATCCTC | 319 | STQGAIL | 1536 | 137.294 |
| 261 | TGGAATACGAATATGGCGATT | 320 | WNTNMAI | 1537 | 137.17 |
| 262 | GTCTCATCGTACGAAAAAATA | 321 | VSSYEKI | 1538 | 137.055 |
| 263 | GTGCTGAGTACGGGGCAGCGG | 322 | VLSTGQR | 1539 | 136.9001 |
| 264 | CCTATACCCCACGGTTCATCC | 323 | PIPHGSS | 1540 | 136.523 |
| 265 | AACGTGTCACTAACGCAAACG | 324 | NVSLTQT | 1541 | 136.4003 |
| 266 | TCTACCATCGGCAACAGCACG | 325 | STIGNST | 1542 | 136.393 |
| 267 | TCTGAGAAGCTGACTGATAAG | 326 | SEKLTDK | 1543 | 136.36 |
| 268 | TCCAAAGACTCGAACATAAGT | 327 | SKDSNIS | 1544 | 136.166 |
| 269 | GCGAATAGTAATCATGAGCGT | 328 | ANSNHER | 1545 | 136.102 |
| 270 | AGGGATACGGGTGATAAGGCT | 329 | RDTGDKA | 1546 | 135.913 |
| 271 | AGAACAGACACGCCGTCAACC | 330 | RTDTPST | 1547 | 135.583 |
| 272 | CCTACTATGTCGAGTCTGAAT | 331 | PTMSSLN | 1548 | 135.539 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 273 | GATATTACTAATCAGTCGTAT | 332 | DITNQSY | 1549 | 135.473 |
| 274 | CTTGTAAAACCGGAAACTTGG | 333 | LVKPETW | 1550 | 134.988 |
| 275 | GGGACTTCCTTGGAAAACCGA | 334 | GTSLENR | 1551 | 134.981 |
| 276 | GCTGCTGGTAATCCTACTCGT | 335 | AAGNPTR | 1552 | 134.779 |
| 277 | CACAACGTCGGCCTAGGACAC | 336 | HNVGLGH | 1553 | 134.677 |
| 278 | GTATCAACGACAACGGACCGG | 337 | VSTTTDR | 1554 | 134.639 |
| 279 | TATTTGTCGTCTGGTAAGATG | 338 | YLSSGKM | 1555 | 134.553 |
| 280 | GATAGTCGGAATGCTGCTTTG | 339 | DSRNAAL | 1556 | 134.213 |
| 281 | GTGGAGCGGAATACTGATATG | 340 | VERNTDM | 1557 | 133.962 |
| 282 | ACTGTTGGGAGTAATTCTATT | 341 | TVGSNSI | 1558 | 133.95 |
| 283 | GTGCGGTCTGGTAATAAGCCG | 342 | VRSGNKP | 1559 | 133.87 |
| 284 | GGCAGTTCGGGGAACAGCGGA | 343 | GSSGNSG | 1560 | 133.776 |
| 285 | TCTACTTCAATAGGAGTGGTA | 344 | STSIGVV | 1561 | 133.69 |
| 286 | CCGAGTCAGAGTAGGTCGCTT | 345 | PSQSRSL | 1562 | 133.6751 |
| 287 | CGGAATGAGAATCTTAATAAT | 346 | RNENLNN | 1563 | 133.26 |
| 288 | TCGTTGGGTAAGAGGGAGGAG | 347 | SLGKREE | 1564 | 133.032 |
| 289 | TCACGCTTGGACTCGAGCTCC | 348 | SRLDSSS | 1565 | 132.783 |
| 290 | GATTCGACGTATGTTTTGGCT | 349 | DSTYVLA | 1566 | 132.54 |
| 291 | GAGCGTAATCCTATTTCTGAT | 350 | ERNPISD | 1567 | 132.49 |
| 292 | GTTAGCTCCGGCCACACGAAA | 351 | VSSGHTK | 1568 | 132.466 |
| 293 | AAGTATACGGAGTCGAATGCG | 352 | KYTESNA | 1569 | 132.305 |
| 294 | AACCGCAACTCAGTTGGGACT | 353 | NRNSVGT | 1570 | 132.2576 |
| 295 | CACGAAAGCCACTACGTGTCA | 354 | HESHYVS | 1571 | 132.014 |
| 296 | ACGACTGGGGGGACGGGGATG | 355 | TTGGTGM | 1572 | 131.954 |
| 297 | GCGACTGATAAGATGACTCCT | 356 | ATDKMTP | 1573 | 131.931 |
| 298 | TCCGCGTCTAGCGGCGCTACA | 357 | SASSGAT | 1574 | 131.886 |
| 299 | TCAACCACTACTGGCCACATG | 358 | STTTGHM | 1575 | 131.581 |
| 300 | ATAATAGCATCCTCTACCACG | 359 | IIASSTT | 1576 | 131.506 |
| 301 | GATACTGGGTCTAGGATTGCG | 360 | DTGSRIA | 1577 | 131.486 |
| 302 | TGGGCTGATGATTCGCAGCGG | 361 | WADDSQR | 1578 | 131.47 |
| 303 | AGGGGTAACACTCTCGAAATG | 362 | RGNTLEM | 1579 | 131.381 |
| 304 | AATCTGCAGGTGAATGCGAAT | 363 | NLQVNAN | 1580 | 131.172 |
| 305 | GCGACGACTCAGCTGATGACT | 364 | ATTQLMT | 1581 | 130.96 |
| 306 | GCTGATACGAATATTATTGTG | 365 | ADTNIIV | 1582 | 130.47 |
| 307 | GCCATAACAATCACTCAAAAA | 366 | AITITQK | 1583 | 130.225 |
| 308 | GACTCCAACAAAGGAGCGACG | 367 | DSNKGAT | 1584 | 130.1749 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 309 | GGCAACGCTTCCGGAAACCCA | 368 | GNASGNP | 1585 | 129.97 |
| 310 | ACGATGGGTGCTAAAGGTACT | 369 | TMGAKGT | 1586 | 129.92 |
| 311 | TATCTGCAGACGGGTACTCTG | 370 | YLQTGTL | 1587 | 129.907 |
| 312 | GCATTACACACCAAAGACCTA | 371 | ALHTKDL | 1588 | 129.846 |
| 313 | GTCGACAAAAGCGAAGCCGTC | 372 | VDKSEAV | 1589 | 129.734 |
| 314 | GGGAGGACGGATCTTATGGCG | 373 | GRTDLMA | 1590 | 129.651 |
| 315 | GGCACGGAACCGCGCACTGCA | 374 | GTEPRTA | 1591 | 129.37 |
| 316 | AGAGGCGACATGTCACGAGAA | 375 | RGDMSRE | 1592 | 129.137 |
| 317 | CGGGGGATACTAAGTCTAAG | 376 | RGDTKSK | 1593 | 128.94 |
| 318 | GGGACATTAGCCTCAATGTCC | 377 | GTLASMS | 1594 | 128.734 |
| 319 | CAGAAGTCTGTGACGTATTCG | 378 | QKSVTYS | 1595 | 128.602 |
| 320 | AGTACGGGCAGACTCTTGTT | 379 | STGQTLV | 1596 | 128.1669 |
| 321 | TCGCACATAAACATGGGGTCG | 380 | SHINMGS | 1597 | 128.101 |
| 322 | GCGTTGAATGGTACTGGTAAT | 381 | ALNGTGN | 1598 | 128.045 |
| 323 | ACTACGAGTTCGAATCAGCAT | 382 | TTSSNQH | 1599 | 128.003 |
| 324 | AAAAACTACGCAAGCACCGAC | 383 | KNYASTD | 1600 | 127.84 |
| 325 | GAATCCACAAGCAGGACGTAC | 384 | ESTSRTY | 1601 | 127.765 |
| 326 | CCGCGTTCTATTACGGAGTTG | 385 | PRSITEL | 1602 | 127.623 |
| 327 | TACATAGCCGGAGGAGAAAAA | 386 | YIAGGEK | 1603 | 127.544 |
| 328 | ACTAGTAATTATATGCATGAG | 387 | TSNYMBE | 1604 | 127.522 |
| 329 | TTGGATCCTAATAGTACTCGG | 388 | LDPNSTR | 1605 | 127.175 |
| 330 | CACAGTGACATGGGCTCAAGC | 389 | HSDMGSS | 1606 | 127.01 |
| 331 | GACACCGCCAACCGATCCACA | 390 | DTANRST | 1607 | 127.01 |
| 332 | AACGCCGGACACAGCGGTCAA | 391 | NAGHSGQ | 1608 | 126.611 |
| 333 | AGTTTGGGGTCGGATCGTATG | 392 | SLGSDRM | 1609 | 126.579 |
| 334 | GACAACCAACAAGCCCTAGCT | 393 | DNQQALA | 1610 | 126.49 |
| 335 | CCATCCTCAGCGGGTAGCACA | 394 | PSSAGST | 1611 | 126.201 |
| 336 | GACAGGAAAGGGTACGACGCA | 395 | DRKYDA | 1612 | 126.06 |
| 337 | GGAGGAAACCAAAACCTTACT | 396 | GGNQNLT | 1613 | 125.7806 |
| 338 | GTGAATCTGAATGAGACGGAG | 397 | VNLNETE | 1614 | 125.719 |
| 339 | TCCCCCGGCAACGGGTTGCTA | 398 | SPGNGLL | 1615 | 125.687 |
| 340 | TCTGTCGGGGACCTCACAAAA | 399 | SVGDLTK | 1616 | 125.627 |
| 341 | CGATACGAATCCGTCGGACTC | 400 | RYESVGL | 1617 | 125.54 |
| 342 | ACGAGAGAATTGACAAAAAAC | 401 | TRELTKN | 1618 | 125.47 |
| 343 | ACTCCAACTAACGGGAACCCT | 402 | TPTNGNP | 1619 | 125.37 |
| 344 | GCGACTGATCAGCGTTCGAGG | 403 | ATDQRSR | 1620 | 125.26 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 345 | GGAACATCGGCAGAATCACGC | 404 | GTSAESR | 1621 | 125.214 |
| 346 | AGGATGCTCTCTACTTTGCCT | 405 | RMLSTLP | 1622 | 125.088 |
| 347 | GGTATCAACTCCTCACACTTC | 406 | GINSSHF | 1623 | 125.044 |
| 348 | AGTAGCTCAACTGAAGGGCAA | 407 | SSSTEGQ | 1624 | 124.971 |
| 349 | GACAAACAACAAACCGGACAA | 408 | DKQQTGQ | 1625 | 124.923 |
| 350 | ACCCAACACCTACCATCCACA | 409 | TQHLPST | 1626 | 124.773 |
| 351 | GGTCTGGGGCAGCCTCAGTTG | 410 | GLGQPQL | 1627 | 124.752 |
| 352 | GTGACTAATGAGAGTCGTGCT | 411 | VTNESRA | 1628 | 124.728 |
| 353 | GGCAACTCGAACTACCGAGAA | 412 | GNSNYRE | 1629 | 124.482 |
| 354 | TGGAATGCTGAGAATAGTAAG | 413 | WNAENSK | 1630 | 124.373 |
| 355 | CCTGGGAGTCAGCGTCAGGAT | 414 | PGSQRQD | 1631 | 124.325 |
| 356 | CATACGTATTCGCAGGCTGAT | 415 | HTYSQAD | 1632 | 124.3 |
| 357 | ACTGCCGGCAACCTAAGAAGT | 416 | TAGNLRS | 1633 | 124.203 |
| 358 | GGCAGACACCTTCAATCGGAC | 417 | GRHLQSD | 1634 | 124.19 |
| 359 | AACAACGCACACACCGCCACT | 418 | NNAHTAT | 1635 | 124.118 |
| 360 | AGTACGAGTCAGGAGAATAGG | 419 | STSQENR | 1636 | 124.0658 |
| 361 | AGGGGTGATACTATGAATTAT | 420 | RGDTMNY | 1637 | 124.04 |
| 362 | CCGGTTGCTACTCAGCATGCG | 421 | PVATQHA | 1638 | 123.9189 |
| 363 | GGGCATTTGAATGCTCCGACT | 422 | GHLNAPT | 1639 | 123.495 |
| 364 | CAAATATTAAACTACTCAGTC | 423 | QILNYSV | 1640 | 123.4 |
| 365 | CAAAACCACGCGTCTGGTGAA | 424 | QNHASGE | 1641 | 123.372 |
| 366 | GGTTTAACAGGGCGGGAACTA | 425 | GLTGREL | 1642 | 123.32 |
| 367 | GACGTAGCCGTGACTCAACAC | 426 | DVAVTQH | 1643 | 123.31 |
| 368 | GCAACTTACACCGGGCGAACA | 427 | ATYTGRT | 1644 | 123.292 |
| 369 | AAAGAACTACAATGGCAACGA | 428 | KELQWQR | 1645 | 123.251 |
| 370 | GCTAGTTATAGTAGTATGGTG | 429 | ASYSSMV | 1646 | 123.193 |
| 371 | GTTATTAGTCATGGGGCGCTG | 430 | VISHGAL | 1647 | 123.094 |
| 372 | CCTATACACCACGGTTCATCC | 431 | PIHHGSS | 1648 | 123.09 |
| 373 | GTGGATAAGAATCATCCTTTG | 432 | VDKNHPL | 1649 | 123.04 |
| 374 | ACCTCGGGTGACCGGTACACG | 433 | TSGDRYT | 1650 | 122.844 |
| 375 | GGGACAAAAAGCTGGCCTGTC | 434 | GTKSWPV | 1651 | 122.8432 |
| 376 | TACAACGCCCACGAATCATTC | 435 | YNAHESF | 1652 | 122.813 |
| 377 | AGAGTCCACGACACTCCTTCA | 436 | RVHDTPS | 1653 | 122.7503 |
| 378 | GCACAAATCGAATCAGGCCGA | 437 | AQIESGR | 1654 | 122.66 |
| 379 | TGGAAGGATAATATGCGGATG | 438 | WKDNMRM | 1655 | 122.624 |
| 380 | ATGCCTAGTGAACCACCAGGG | 439 | MPSEPPG | 1656 | 122.51 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 381 | CGTGGTGATTATCCGACGTCG | 440 | RGDYPTS | 1657 | 122.487 |
| 382 | TTTCATAATGAGTCTTATGGG | 441 | FHNESYG | 1658 | 122.36 |
| 383 | TTGAATACGATGATTGATAAG | 442 | LNTMIDK | 1659 | 122.272 |
| 384 | TCCACACTAAGCCAAGGAGCA | 443 | STLSQGA | 1660 | 122.2662 |
| 385 | CCTTTGCACAACATACCTCCT | 444 | PLHNIPP | 1661 | 122.24 |
| 386 | GCTTCGTCTACGTTTTTGCCT | 445 | ASSTFLP | 1662 | 122.24 |
| 387 | ATGGAAGGAATGGGACTCGGA | 446 | MEGMGLG | 1663 | 122.04 |
| 388 | AAGGATTATAAGCCGTATGCT | 447 | KDYKPYA | 1664 | 121.95 |
| 389 | AATTTGCAGTCTGGTGTTCAG | 448 | NLQSGVQ | 1665 | 121.91 |
| 390 | ACAACTCTTAGCCAACAAAGC | 449 | TTLSQQS | 1666 | 121.82 |
| 391 | CTTATGTCGTCTACTTCCTCA | 450 | LMSSTSS | 1667 | 121.536 |
| 392 | ACTGGCCAAGGATTCTCGGCA | 451 | TGQGFSA | 1668 | 121.45 |
| 393 | TCTACAATCGGCAACAGCACG | 452 | STIGNST | 1669 | 121.27 |
| 394 | CTGAGGGCGAGTGAGGCTCCG | 453 | LRASEAP | 1670 | 121.2297 |
| 395 | CAGCCTAATAATGGTAATCAT | 454 | QPNNGNH | 1671 | 121.02 |
| 396 | TCGTCAGACGTTACCAGACAA | 455 | SSDVTRQ | 1672 | 120.98 |
| 397 | CGGGGTGACGCAACAGAAATG | 456 | RGDATEM | 1673 | 120.74 |
| 398 | TATAGGGGTAGGGAGGATTGG | 457 | YRGREDW | 1674 | 120.58 |
| 399 | AGCTTGCAACAATCACAATTG | 458 | SLQQSQL | 1675 | 120.491 |
| 400 | AAGCCGACTGCGAATGATTGG | 459 | KPTANDW | 1676 | 120.3784 |
| 401 | CGTCTGACTGATACTATGCAT | 460 | RLTDTMH | 1677 | 120.35 |
| 402 | CTTCATGGGAATTATAGTCCG | 461 | LHGNYSP | 1678 | 120.346 |
| 403 | ATTCCGGTTGGGGCGATGGCT | 462 | IPVGAMA | 1679 | 120.248 |
| 404 | CCGAACACCGCCTCAAACTTC | 463 | PNTASNF | 1680 | 120.24 |
| 405 | ACGAGTAGAGAAGTCAAAGGG | 464 | TSREVKG | 1681 | 120.171 |
| 406 | GACACGTCCTCCGGCAACAGG | 465 | DTSSGNR | 1682 | 119.94 |
| 407 | GAAGCAGTAACAAGTAAATGG | 466 | EAVTSKW | 1683 | 119.919 |
| 408 | CTAATCACAGCCACCACTAAC | 467 | LITATTN | 1684 | 119.872 |
| 409 | GATGGGGGTCGTTCGGGTATT | 468 | DGGRSGI | 1685 | 119.847 |
| 410 | TTCATGGAAGTCATGAAAAAC | 469 | FMEVMKN | 1686 | 119.82 |
| 411 | TCCTACCAAAACCCACCACCA | 470 | SYQNPPP | 1687 | 119.701 |
| 412 | ACTAATGTGACGTTTAAGCTT | 471 | TNVTFKL | 1688 | 119.681 |
| 413 | ATTTCTACGCATACGATGACG | 472 | ISTHTMT | 1689 | 119.64 |
| 414 | GAAACCCAAGGAGCAAGATAC | 473 | ETQGARY | 1690 | 119.591 |
| 415 | GCGGCTTATGAGCATGCGCCT | 474 | AAYEHAP | 1691 | 119.588 |
| 416 | TCAACGAACGACCGTGCGTTA | 475 | STNDRAL | 1692 | 119.57 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 417 | TTCACCGAACGCGCACTCCAA | 476 | FTERALQ | 1693 | 119.423 |
| 418 | GTAGCGGGCTTAGTCGACATA | 477 | VAGLVDI | 1694 | 119.41 |
| 419 | AGCTCGGTAACTAACCTTGCA | 478 | SSVTNLA | 1695 | 119.38 |
| 420 | GATACTACTACTGGTCATCTT | 479 | DTTTGHL | 1696 | 119.27 |
| 421 | ACGCGTAATTTGTCTGAGAGT | 480 | TRNLSES | 1697 | 118.919 |
| 422 | CAGGTGAATGTTGGGCCTGGT | 481 | QVNVGPG | 1698 | 118.831 |
| 423 | AAACAAACGATGTCCGACACA | 482 | KQTMSDT | 1699 | 118.829 |
| 424 | ATGTCGACAACCAGCAAAACT | 483 | MSTTSKT | 1700 | 118.7215 |
| 425 | ACTACAATAGGGACAAACCAA | 484 | TTIGTNQ | 1701 | 118.676 |
| 426 | GGGACTCTGACGCCGAATCTT | 485 | GTLTPNL | 1702 | 118.622 |
| 427 | TTTGATAGTTATAATATTGTG | 486 | FDSYNIV | 1703 | 118.51 |
| 428 | CGTGGTGCGCCTGAGCAAGCG | 487 | RGAPEQA | 1704 | 118.47 |
| 429 | ATCGAAAACGTAAACCACTTG | 488 | IENVNHL | 1705 | 118.42 |
| 430 | AGGTCTCTGGAGAGTCAGGCT | 489 | RSLESQA | 1706 | 118.231 |
| 431 | CAGTATACGAGTCTGAGTCCG | 490 | QYTSLSP | 1707 | 118.006 |
| 432 | ACGAAGGGTTATAATGATCTT | 491 | TKGYNDL | 1708 | 117.876 |
| 433 | GTCGCCTCGATGGTACACAAC | 492 | VASMVHN | 1709 | 117.874 |
| 434 | TCCACAACCCACACCTCAGCA | 493 | STTHTSA | 1710 | 117.821 |
| 435 | CTTGCGCACCCACAACCAAAC | 494 | LAHPQPN | 1711 | 117.542 |
| 436 | TCGATAAACAACATAGGCGCA | 495 | SINNIGA | 1712 | 117.538 |
| 437 | GCTATAGACTCCATCAAAATG | 496 | AIDSIKM | 1713 | 117.472 |
| 438 | TCTATGTATGGGCAGGCTGGG | 497 | SMYGQAG | 1714 | 117.362 |
| 439 | GAGTATGCTAATGCTAAGACT | 498 | EYANAKT | 1715 | 117.351 |
| 440 | TATCGGGCTTCGGATGTGGCG | 499 | YRASDVA | 1716 | 117.348 |
| 441 | GTTAGTTTGGAGAGTCGGTTG | 500 | VSLESRL | 1717 | 117.332 |
| 442 | ATTGAGACTAGTTCGCGTTCG | 501 | IETSSRS | 1718 | 117.176 |
| 443 | ATGGGAGTGAAACCCGAACAA | 502 | MGVKPEQ | 1719 | 116.975 |
| 444 | GCGCTTCCGTCTCGTGAGCGG | 503 | ALPSRER | 1720 | 116.914 |
| 445 | GGCACCGGATCTTCAGCGCAC | 504 | GTGSSAH | 1721 | 116.896 |
| 446 | CAAACGAACACCAACGACAGA | 505 | QTNTNDR | 1722 | 116.664 |
| 447 | GTATTACACTCTGTATCAGCA | 506 | VLHSVSA | 1723 | 116.583 |
| 448 | CCTTATTCTGCTACTGATCGG | 507 | PYSATDR | 1724 | 116.577 |
| 449 | GCAAACTCCGGATTACACAAC | 508 | ANSGLHN | 1725 | 116.505 |
| 450 | TATGAGAGTACTCATGTTAAT | 509 | YESTHVN | 1726 | 116.418 |
| 451 | AACAACGCACTAGTAGGAAGT | 510 | NNALVGS | 1727 | 116.34 |
| 452 | GGTATCAACTCCTCACACATC | 511 | GINSSHI | 1728 | 116.28 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 453 | AGTATTTCTGATAAGAATCAG | 512 | SISDKNQ | 1729 | 116.141 |
| 454 | GACCACCAACAAGCCCTAGCA | 513 | DHQQALA | 1730 | 116.13 |
| 455 | GACTCTACCAAAGCCATGCAA | 514 | DSTKAMQ | 1731 | 116.116 |
| 456 | ACTATTACTAGTCAGTCGGTG | 515 | TITSQSV | 1732 | 115.95 |
| 457 | GGCGCCCGTACAATCTTAGAC | 516 | GARTILD | 1733 | 115.938 |
| 458 | GAGCATAGTCCTACGACTGGT | 517 | EHSPTTG | 1734 | 115.8995 |
| 459 | GGGCTCACAGGATACCCAATG | 518 | GLTGYPM | 1735 | 115.844 |
| 460 | ACGATGGAATCCGGCCGCCAC | 519 | TMESGRH | 1736 | 115.82 |
| 461 | TCTGCGTCGAAAGTGGAATAC | 520 | SASKVEY | 1737 | 115.719 |
| 462 | GATAAGTCTAATTATAGTATT | 521 | DKSNYSI | 1738 | 115.714 |
| 463 | TTCAACGAAACTGCCGGGCGA | 522 | FNETAGR | 1739 | 115.65 |
| 464 | CAAAAATCGGAAACCTACACT | 523 | QKSETYT | 1740 | 115.528 |
| 465 | GCACTTACCCGTATGCCTAAC | 524 | ALTRMPN | 1741 | 115.476 |
| 466 | CGTAACGGCTCCGCCCAAAGC | 525 | RNGSAQS | 1742 | 115.465 |
| 467 | GCGAGGGATACGCCTGGGATT | 526 | ARDTPGI | 1743 | 115.432 |
| 468 | ATTGTTAATGCTGAGATTTAT | 527 | IVNAEIY | 1744 | 115.31 |
| 469 | CGACAAGGCGACTTAAAAGAA | 528 | RQGDLKE | 1745 | 115.3059 |
| 470 | CGAAACAACCCATCGCACGAC | 529 | RNNPSHD | 1746 | 115.224 |
| 471 | CTCGCCCACAACTACTTAAGC | 530 | LAHNYLS | 1747 | 115.195 |
| 472 | AACACCCACAACCTACAAATG | 531 | NTHNLQM | 1748 | 115.171 |
| 473 | CGAGGAGACCACAGCACACAG | 532 | RGDHSTQ | 1749 | 115.12 |
| 474 | CTCCACGGAGTCAGCAGTATA | 533 | LHGVSSI | 1750 | 115.105 |
| 475 | GGTATTAATCATGTGGCGTCT | 534 | GINHVAS | 1751 | 115.102 |
| 476 | ACTGATAAGCTTCAGGGTGTG | 535 | TDKLQGV | 1752 | 115.062 |
| 477 | GGAACCTCCATAGACTACGTA | 536 | GTSIDYV | 1753 | 115.053 |
| 478 | TCGAACACTGCCCCCCCCCCC | 537 | SNTAPPP | 1754 | 115.034 |
| 479 | ACTGCTAAGAGTTATGGGCCT | 538 | TAKSYGP | 1755 | 115.006 |
| 480 | GACCACCAACAAGCACTAGCT | 539 | DHQQALA | 1756 | 114.98 |
| 481 | ACACAAGTAGTCGCAAGAACA | 540 | TQVVART | 1757 | 114.9299 |
| 482 | AGTCCTCCTAGTACGTCGGGT | 541 | SPPSTSG | 1758 | 114.816 |
| 483 | CCTATGCGAACACCACCGTAC | 542 | PMRTPPY | 1759 | 114.806 |
| 484 | GCTGCTGGTAATACTACTCGT | 543 | AAGNTTR | 1760 | 114.78 |
| 485 | AGAGGCGACTAATCCACACCC | 544 | RGD*STP | 1761 | 114.78 |
| 486 | CTAGCGAAAACTGTCGCTATC | 545 | LAKTVAI | 1762 | 114.722 |
| 487 | TCTAAATCTGAAAACCTGCAA | 546 | SKSENLQ | 1763 | 114.59 |
| 488 | ACTCAGACGTCGTATGCTACG | 547 | TQTSYAT | 1764 | 114.505 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 489 | ACTGGGGATAGGACTTCGGTG | 548 | TGDRTSV | 1765 | 114.4766 |
| 490 | ATATCGCAAGGCTCGAGCCTC | 549 | ISQGSSL | 1766 | 114.305 |
| 491 | CTTGTTCAGATGGGGAGTGTG | 550 | LVQMGSV | 1767 | 114.256 |
| 492 | TTATCCGCAACATCTACGATG | 551 | LSATSTM | 1768 | 114.245 |
| 493 | CAAAACCACAACGAACTAAAA | 552 | QNHNELK | 1769 | 114.217 |
| 494 | CGTGGTGCGCCTGAGCATGCG | 553 | RGAPEHA | 1770 | 114.09 |
| 495 | TCTTCTTTCGGAAAAGACAAC | 554 | SSFGKDN | 1771 | 113.982 |
| 496 | AACGCTAACGCCGGTGGAAAC | 555 | NANAGGN | 1772 | 113.958 |
| 497 | GATCATCATCCTCAGAGTCGT | 556 | DHHPQSR | 1773 | 113.83 |
| 498 | ATGAGGCATGAGGCTCCTCTT | 557 | MRHEAPL | 1774 | 113.819 |
| 499 | AAGGGGGATGGTGCTTATGAG | 558 | KGDGAYE | 1775 | 113.742 |
| 500 | CCTATGAATGGTATTCTGTTG | 559 | PMNGILL | 1776 | 113.722 |
| 501 | AGTAGTGGGGGTATGAAGGCG | 560 | SSGGMKA | 1777 | 113.69 |
| 502 | GTGCTGGTTACTCAGAATCAT | 561 | VLVTQNH | 1778 | 113.631 |
| 503 | GAGATTAATAATCGGACTGGT | 562 | EINNRTG | 1779 | 113.588 |
| 504 | TTACCAACAGGCGTCCTGCCC | 563 | LPTGVLP | 1780 | 113.561 |
| 505 | GCCTACGGTATCAGAGAAGTG | 564 | AYGIREV | 1781 | 113.547 |
| 506 | TCGACAAACTCTATAGGCGCC | 565 | STNSIGA | 1782 | 113.471 |
| 507 | GTGCAGTTGACGCATAATGGG | 566 | VQLTHNG | 1783 | 113.43 |
| 508 | GTTCAGTTGGAGAATGCGAAT | 567 | VQLENAN | 1784 | 113.43 |
| 509 | GGAAAAGCCAACGACGGTTCT | 568 | GKANDGS | 1785 | 113.427 |
| 510 | ACCGGGGTTCGAGAAACCATA | 569 | TGVRETI | 1786 | 113.41 |
| 511 | GGCCTGAACCAGATCACATCG | 570 | GLNQITS | 1787 | 113.4 |
| 512 | ACGGAGAAGGCGAGTCCTCTG | 571 | TEKASPL | 1788 | 113.381 |
| 513 | TTTCTGGAGGGTGTTGCGCAG | 572 | FLEGVAQ | 1789 | 113.333 |
| 514 | ACGAATTATAATATTGGTCCG | 573 | TNYNIGP | 1790 | 113.318 |
| 515 | AGAGGAGACTTGACAACCACA | 574 | RGDLTTT | 1791 | 113.29 |
| 516 | ATGATGAATGTGAGTGGTCAT | 575 | MMNVSGH | 1792 | 113.09 |
| 517 | TCTCAGTCGATTAATGGGCTT | 576 | SQSINGL | 1793 | 113.084 |
| 518 | CTCACGACTTTAACTAACCAC | 577 | LTTLTNH | 1794 | 113.033 |
| 519 | AACTCTGTTCAATCCACCCCA | 578 | NSVQSTP | 1795 | 113.021 |
| 520 | TATAATACGGATCGGACTAAT | 579 | YNTDRTN | 1796 | 113.001 |
| 521 | GAGAAGCCTCAGCATAATAGT | 580 | EKPQHNS | 1797 | 112.98 |
| 522 | ACGATGGCTACAAACTTAAGT | 581 | TMATNLS | 1798 | 112.937 |
| 523 | GTGGGGACGCATTTGCATTCG | 582 | VGTHLHS | 1799 | 112.918 |
| 524 | GACGCCCACCACTCAAGCAGC | 583 | DAHHSSS | 1800 | 112.88 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 525 | CTTGTGGGGACTTTGGTGTAT | 584 | LVGTLVY | 1801 | 112.853 |
| 526 | TATGGTGTGCAGGCGAATAGT | 585 | YGVQANS | 1802 | 112.806 |
| 527 | GTTTTGTCTGATAAGGCGTAT | 586 | VLSDKAY | 1803 | 112.787 |
| 528 | CTTGAGGGTCAGAATAAGACG | 587 | LEGQNKT | 1804 | 112.731 |
| 529 | GAGGTTAGTAATAATAATTAT | 588 | EVSNNNY | 1805 | 112.69 |
| 530 | GCCCACCAACAAGCCCTAGCT | 589 | AHQQALA | 1806 | 112.67 |
| 531 | CTTCCGACCACACTCAACCAC | 590 | LPTTLNH | 1807 | 112.667 |
| 532 | TACATAGCAGGTGGTGAACAA | 591 | YIAGGEQ | 1808 | 112.6513 |
| 533 | AATTCTGGTACTCTTTATCAG | 592 | NSGTLYQ | 1809 | 112.609 |
| 534 | CGGGGTCTGCCTGATGTTAAT | 593 | RGLPDVN | 1810 | 112.43 |
| 535 | AACCAACAACTATCCCACTCA | 594 | NQQLSHS | 1811 | 112.375 |
| 536 | AATCCTAGTTATGATCATCGG | 595 | NPSYDHR | 1812 | 112.363 |
| 537 | ATAGACAGCGACACCTTCGTA | 596 | IDSDTFV | 1813 | 112.355 |
| 538 | ACCGCTTACCTTGCGGGATTA | 597 | TAYLAGL | 1814 | 112.17 |
| 539 | CATAGTAATGTTAGTCTTGAG | 598 | HSNVSLE | 1815 | 112.162 |
| 540 | GGTAATAATTTGAGTTTGTCT | 599 | GNNLSLS | 1816 | 112.16 |
| 541 | GTTATGGATACGCATGGGATG | 600 | VMDTHGM | 1817 | 112.145 |
| 542 | GCGTATAATATGTCGTCTGTT | 601 | AYNMSSV | 1818 | 112.14 |
| 543 | ACTAACGCCATCTCTCAAACG | 602 | TNAISQT | 1819 | 112.063 |
| 544 | GCAACACACGCCATGCGCCCA | 603 | ATHAMRP | 1820 | 112.016 |
| 545 | ATGTTAAACAACACAATGATG | 604 | MLNNTMM | 1821 | 111.939 |
| 546 | ATTAGTTCGGGGATTTTGTCG | 605 | ISSGILS | 1822 | 111.907 |
| 547 | CGCCAAGGCAGCTTGATGATA | 606 | RQGSLMI | 1823 | 111.83 |
| 548 | ACGACTGATAAGGGTATTAAT | 607 | TTDKGIN | 1824 | 111.818 |
| 549 | CACAACTTAATGACCCAAATA | 608 | HNLMTQI | 1825 | 111.77 |
| 550 | AACCAAAACACCTACGAACTG | 609 | NQNTYEL | 1826 | 111.756 |
| 551 | GCTAACACCGTCACAGAACGA | 610 | ANTVTER | 1827 | 111.7323 |
| 552 | TCTACGCTGCAGACTAATGGT | 611 | STLQTNG | 1828 | 111.683 |
| 553 | CCCAACGAATACAAAGCACCG | 612 | PNEYKAP | 1829 | 111.646 |
| 554 | ATGCAAACACGCTCGGACACA | 613 | MQTRSDT | 1830 | 111.629 |
| 555 | GGAACAGGGTACGCTGGATCA | 614 | GTGYAGS | 1831 | 111.6183 |
| 556 | ATGGGTATGCAGAATACGCAT | 615 | MGMQNTH | 1832 | 111.599 |
| 557 | TCTAGTAAGGAGCGTACATCG | 616 | SSKERTS | 1833 | 111.57 |
| 558 | CGAACGGACACCCCCTACACC | 617 | RTDTPYT | 1834 | 111.562 |
| 559 | ACTGCGCTGCGGGATAATAAG | 618 | TALRDNK | 1835 | 111.51 |
| 560 | AGGATGTCTGAGAGTTCGGAT | 619 | RMSESSD | 1836 | 111.51 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 561 | AACCAATCTATAAGCATGGAC | 620 | NQSISMD | 1837 | 111.491 |
| 562 | TCGCTTGGGCATAGTAATAAT | 621 | SLGHSNN | 1838 | 111.432 |
| 563 | CTTAATAGTGGTGGTGCGATG | 622 | LNSGGAM | 1839 | 111.361 |
| 564 | AACGAACAATTCGAAAAAGTC | 623 | NEQFEKV | 1840 | 111.341 |
| 565 | ATGATGGCGAATAATATGCAG | 624 | MMANNMQ | 1841 | 111.28 |
| 566 | AGTCGGCGCGAAGAACAACCA | 625 | SRREEQP | 1842 | 111.2512 |
| 567 | GCGACTATGACTTCGTCGACG | 626 | ATMTSST | 1843 | 111.238 |
| 568 | CGTGGTTCAGACGGAGGATTG | 627 | RGSDGGL | 1844 | 111.172 |
| 569 | AGTTTGACGCCTAATAATCTT | 628 | SLTPNNL | 1845 | 111.152 |
| 570 | GCTACTCTTTCTCCGCATGCT | 629 | ATLSPHA | 1846 | 111.132 |
| 571 | TATCTGCAGGAGAAGTTTCCT | 630 | YLQEKFP | 1847 | 111.112 |
| 572 | GGCACCGGGTACCCAAACCAA | 631 | GTGYPNQ | 1848 | 111.111 |
| 573 | AATTATCCTTCGGTTCAGGAG | 632 | NYPSVQE | 1849 | 111.07 |
| 574 | ACTGACGCATCGGGTAGATCA | 633 | TDASGRS | 1850 | 111.017 |
| 575 | CGTGTGATTACTGCGGGTGAT | 634 | RVITAGD | 1851 | 111.009 |
| 576 | GTGACTGTGAGTAATAGTCTG | 635 | VTVSNSL | 1852 | 110.95 |
| 577 | TTGTTGACGGCTCCGCATAGG | 636 | LLTAPHR | 1853 | 110.908 |
| 578 | TCAATCGCAAACCACATGATA | 637 | SIANHMI | 1854 | 110.861 |
| 579 | ATGCCTTCGAAAGGCGAAGTA | 638 | MPSKGEV | 1855 | 110.816 |
| 580 | AACATGACCAACGAACGGCTC | 639 | NMTNERL | 1856 | 110.801 |
| 581 | TCATTCTCTTCAGGCATAATG | 640 | SFSSGIM | 1857 | 110.771 |
| 582 | CGCGACCGTCAAGACTCGGTA | 641 | RDRQDSV | 1858 | 110.754 |
| 583 | CACGGTGACCGAACAGCTTTA | 642 | HGDRTAL | 1859 | 110.748 |
| 584 | GAAGTACGGGGCAGCGTGCCA | 643 | EVRGSVP | 1860 | 110.747 |
| 585 | CTGATTTCGACTGGTAATAAT | 644 | LISTGNN | 1861 | 110.735 |
| 586 | CCAACATCTGGGGACAAACCG | 645 | PTSGDKP | 1862 | 110.735 |
| 587 | AAAGCGGACCACAGTGGGGCA | 646 | KADHSGA | 1863 | 110.73 |
| 588 | CTAAACGACGTCTACCGTAAA | 647 | LNDVYRK | 1864 | 110.724 |
| 589 | AACAGTTTGCAAGCAAGTGCA | 648 | NSLQASA | 1865 | 110.72 |
| 590 | TATCATAATGAGATTATGACG | 649 | YHNEIMT | 1866 | 110.708 |
| 591 | AACAACACCCTAAACATCCTA | 650 | NNTLNIL | 1867 | 110.69 |
| 592 | TCTTATGGGCAGGGTCTGGAG | 651 | SYGQGLE | 1868 | 110.684 |
| 593 | ATGATAAAAACCAACATGTTG | 652 | MIKTNML | 1869 | 110.668 |
| 594 | ACCGAAGCGGGCCGCCCCCAA | 653 | TEAGRPQ | 1870 | 110.663 |
| 595 | AGGATTGATCAGACTAATGTG | 654 | RIDQTNV | 1871 | 110.624 |
| 596 | GAGGGGCATAATCGTGGTATT | 655 | EGHNRGI | 1872 | 110.559 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 597 | ATGGGGACTGAGTATCGTATG | 656 | MGTEYRM | 1873 | 110.524 |
| 598 | TCGGGTATGAATAGTAATAAG | 657 | SGMNSNK | 1874 | 110.499 |
| 599 | TTGACTAATGATAATAAGTTG | 658 | LTNDNKL | 1875 | 110.479 |
| 600 | TTACACAACTACCAAGACCGT | 659 | LHNYQDR | 1876 | 110.438 |
| 601 | AAGTCTAATTTGGAGGGTAAG | 660 | KSNLEGK | 1877 | 110.438 |
| 602 | CTTACTGGTCAGAATGCGATT | 661 | LTGQNAI | 1878 | 110.416 |
| 603 | CATACTGTGGGGGCTATGCAT | 662 | HTVGAMH | 1879 | 110.41 |
| 604 | CTCCAACTGGCTACATCCCAC | 663 | LQLATSH | 1880 | 110.384 |
| 605 | AGTCTGAATGGGGTGTTGGTT | 664 | SLNGVLV | 1881 | 110.359 |
| 606 | AGTCACAACCAAGTAAACGTA | 665 | SHNQVNV | 1882 | 110.349 |
| 607 | AGTTTGAGTACTGATGTGTTT | 666 | SLSTDVF | 1883 | 110.261 |
| 608 | ATGGTAGGTCGTGCCGAAATC | 667 | MVGRAEI | 1884 | 110.224 |
| 609 | TTGTCTAGTATGAGTACGGAT | 668 | LSSMSTD | 1885 | 110.204 |
| 610 | TCCTACAGTACTTCAACACCG | 669 | SYSTSTP | 1886 | 110.189 |
| 611 | TCCGAATTAATGGTCAGACCC | 670 | SELMVRP | 1887 | 110.0813 |
| 612 | TGGAACGGAAACGCCACACAA | 671 | WNGNATQ | 1888 | 110.039 |
| 613 | ATGGATACTGAGCTTTATAGG | 672 | MDTELYR | 1889 | 109.985 |
| 614 | AGGACGAGTCCTGATACGAAT | 673 | RTSPDTN | 1890 | 109.977 |
| 615 | TTCTCAACGCAAGACATAAGC | 674 | FSTQDIS | 1891 | 109.948 |
| 616 | ACGACTGTGCTGGGGAATAAT | 675 | TTVLGNN | 1892 | 109.94 |
| 617 | CAGCGTGATGCTGCGTATGCT | 676 | QRDAAYA | 1893 | 109.927 |
| 618 | CACCAAACCGTGGTCCCTACT | 677 | HQTVVPT | 1894 | 109.8948 |
| 619 | TCTAATCCGGGTAATCATAAT | 678 | SNPGNHN | 1895 | 109.853 |
| 620 | TGGGAGACTATGGCTAAGCCT | 679 | WETMAKP | 1896 | 109.818 |
| 621 | GGTCTTTATCAGAATCCTACG | 680 | GLYQNPT | 1897 | 109.73 |
| 622 | CTTAATCTTACTAATCATAAT | 681 | LNLTNHN | 1898 | 109.727 |
| 623 | ATGAGTCTCGCCTCCACCCAA | 682 | MSLASTQ | 1899 | 109.672 |
| 624 | ACGTCCCAAACCGTCCGAGTA | 683 | TSQTVRV | 1900 | 109.654 |
| 625 | GGAGCAACGGTCAACACGCGA | 684 | GATVNTR | 1901 | 109.64 |
| 626 | AAAGGGGGAAACCTCACCGCA | 685 | KGGNLTA | 1902 | 109.632 |
| 627 | GCGTGGTCTCAAGTCCTGACG | 686 | AWSQVLT | 1903 | 109.587 |
| 628 | GTAGAACACGTAGCCCACCAA | 687 | VEHVAHQ | 1904 | 109.552 |
| 629 | CTAATGTCGTCCTACTCATCA | 688 | LMSSYSS | 1905 | 109.546 |
| 630 | TCTCTGGGTGGGAATCCGCCT | 689 | SLGGNPP | 1906 | 109.511 |
| 631 | AAGAATGAGAATACGAATTAT | 690 | KNENTNY | 1907 | 109.5055 |
| 632 | ATATTGGACAACCACCGTTTC | 691 | ILDNHRF | 1908 | 109.489 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 633 | AATTCGTCGCATGTTAATTCT | 692 | NSSHVNS | 1909 | 109.473 |
| 634 | CAGGTGCAGCATGAGAGGGTG | 693 | QVQHERV | 1910 | 109.47 |
| 635 | TTGGGAGGAACCCTGGGAATA | 694 | LGGTLGI | 1911 | 109.46 |
| 636 | ACTCAAGAACGACCACTAATC | 695 | TQERPLI | 1912 | 109.455 |
| 637 | CGTAAGACTGAGGATAGGATG | 696 | RKTEDRM | 1913 | 109.429 |
| 638 | ACCGAACTCACAGCGCGGAAC | 697 | TELTARN | 1914 | 109.398 |
| 639 | CGCGGCGACAACACTTACTCC | 698 | RGDNTYS | 1915 | 109.387 |
| 640 | CAGTCTAATACTAATAATAGT | 699 | QSNTNNS | 1916 | 109.372 |
| 641 | GCTTCTTATAGTATTTCTGAT | 700 | ASYSISD | 1917 | 109.309 |
| 642 | AGCGAACACCACGCCGGAATA | 701 | SEHHAGI | 1918 | 109.281 |
| 643 | CGTGGTGCGCCAGAGCATGCG | 702 | RGAPEHA | 1919 | 109.237 |
| 644 | AATTTTAGTAGTGGTGATGTT | 703 | NFSSGDV | 1920 | 109.229 |
| 645 | AGTGGCATCAACGCCACCGAC | 704 | SGINATD | 1921 | 109.22 |
| 646 | CGGGCTGATGTTTCTTGGTCT | 705 | RADVSWS | 1922 | 109.213 |
| 647 | TGTATGGATGTTGGTAAGGCG | 706 | CMDVGKA | 1923 | 109.203 |
| 648 | GGGGTCGGAGCCACTTCGGTA | 707 | GVGATSV | 1924 | 109.193 |
| 649 | AAAAACAACAACTCAGACAGT | 708 | KNNNSDS | 1925 | 109.177 |
| 650 | AATGTTGCGAGTATTGATAGG | 709 | NVASIDR | 1926 | 109.174 |
| 651 | AATAGTGTGAATGGTCTTCTG | 710 | NSVNGLL | 1927 | 109.154 |
| 652 | ACACTAGACCGAAACCAAACC | 711 | TLDRNQT | 1928 | 109.132 |
| 653 | GACCAAAACTTCGAACGTAGA | 712 | DQNFERR | 1929 | 109.108 |
| 654 | GTCGGTGACAGGAACTTGGTC | 713 | VGDRNLV | 1930 | 109.062 |
| 655 | TTAGAAGTAAACCTGCAAACG | 714 | LEVNLQT | 1931 | 109.057 |
| 656 | ACTAATGGGGGTCGCTTAAT | 715 | TNGGSLN | 1932 | 109.049 |
| 657 | TTCACGCGCACACCAGTAACC | 716 | FTRTPVT | 1933 | 109.033 |
| 658 | ACACCGGCGGAAAGCAAAGTT | 717 | TPAESKV | 1934 | 108.991 |
| 659 | TTTCCTTCGCATAATGGGGCG | 718 | FPSHNGA | 1935 | 108.959 |
| 660 | GCCAGGAACGTAATGCTGGGG | 719 | ARNVMLG | 1936 | 108.958 |
| 661 | ACGATTCAGGATCATATTAAG | 720 | TIQDHIK | 1937 | 108.942 |
| 662 | ATTAATTCGTATTTGCATGAG | 721 | INSYLHE | 1938 | 108.918 |
| 663 | GCGCATGATGTTACTGTGAAT | 722 | AHDVTVN | 1939 | 108.918 |
| 664 | ACTGTGGGGGTTCAGCAGACG | 723 | TVGVQQT | 1940 | 108.8891 |
| 665 | ACAGGTAGTTCAGACAGATTA | 724 | TGSSDRL | 1941 | 108.887 |
| 666 | AATCATGATACTGCTCATGCT | 725 | NHDTAHA | 1942 | 108.884 |
| 667 | GCCGAATCCCAACTAGCTAGC | 726 | AESQLAS | 1943 | 108.8752 |
| 668 | GGTAATGCGTATAATACGACT | 727 | GNAYNTT | 1944 | 108.818 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 669 | AATCATCAGGCTGGTACTACT | 728 | NHQAGTT | 1945 | 108.807 |
| 670 | ACGGTAGGAGAAAACCACCGA | 729 | TVGENHR | 1946 | 108.779 |
| 671 | CTAACTACTAAAATACCCCTC | 730 | LTTKIPL | 1947 | 108.773 |
| 672 | ACTAATTATCCTGAGGCGAAT | 731 | TNYPEAN | 1948 | 108.748 |
| 673 | AATACTGCTCCGCCGAATCAT | 732 | NTAPPNH | 1949 | 108.733 |
| 674 | GTGCTGAGTACGGGGCTGCGG | 733 | VLSTGLR | 1950 | 108.677 |
| 675 | CTCACGTCCCACTCTGCGGGC | 734 | LTSHSAG | 1951 | 108.648 |
| 676 | ATGAATAAGCATGGTGTGCTT | 735 | MNKHGVL | 1952 | 108.5736 |
| 677 | GACCTGACCAGAGCTGCAATA | 736 | DLTRAAI | 1953 | 108.552 |
| 678 | TATATTGTGGATCATGCGAAT | 737 | YIVDHAN | 1954 | 108.526 |
| 679 | AGTGGGCCTGAGAATACGTTG | 738 | SGPENTL | 1955 | 108.526 |
| 680 | CGTTATGGTGATACGGGTATG | 739 | RYGDTGM | 1956 | 108.512 |
| 681 | GATGGTAAGAATAGTTATGCG | 740 | DGKNSYA | 1957 | 108.451 |
| 682 | GAGGCGCATAATCGTGTTATT | 741 | EAHNRVI | 1958 | 108.451 |
| 683 | AGTTTGCAGGCTGGTAGGATG | 742 | SLQAGRM | 1959 | 108.3681 |
| 684 | GATGCGAAGGCTCTTACGACT | 743 | DAKALTT | 1960 | 108.368 |
| 685 | ACCGACACCCGAAAAAACGAC | 744 | TDTRKND | 1961 | 108.357 |
| 686 | GACTCTTCACACTACTCGACA | 745 | DSSHYST | 1962 | 108.219 |
| 687 | ACAATGCACCTTCCCAACCTG | 746 | TMHLPNL | 1963 | 108.214 |
| 688 | CGAGACGGCTCTACTAAAGTT | 747 | RDGSTKV | 1964 | 108.207 |
| 689 | TCAGGGTACCAAATGACAGAA | 748 | SGYQMTE | 1965 | 108.16 |
| 690 | TGCGACTTGTCACAATCATGC | 749 | CDLSQSC | 1966 | 108.133 |
| 691 | AGAAACGCGTCAAACGGCGTA | 750 | RNASNGV | 1967 | 108.044 |
| 692 | CAGTCGCAGAATGTGACTCAG | 751 | QSQNVTQ | 1968 | 108.033 |
| 693 | GATTCTGCTCCGAGTACTATT | 752 | DSAPSTI | 1969 | 108.003 |
| 694 | AGGTCCGTACCATCACCACAC | 753 | RSVPSPH | 1970 | 108.001 |
| 695 | ATGACGTCTGCGTCTCGTGGT | 754 | MTSASRG | 1971 | 107.974 |
| 696 | GCTCTTGCTAGTCGTCCTATG | 755 | ALASRPM | 1972 | 107.907 |
| 697 | CTAAACCTCTCCAACGACTGG | 756 | LNLSNDW | 1973 | 107.899 |
| 698 | GTTTCTACGGCGCAGAGGCAG | 757 | VSTAQRQ | 1974 | 107.896 |
| 699 | CACGCCGACGTTGGCATGAGC | 758 | HADVGMS | 1975 | 107.888 |
| 700 | GCGGGGGGTTTGCTGTCGCGG | 759 | AGGLLSR | 1976 | 107.878 |
| 701 | CATCTTAGTCAGGCTAATCAT | 760 | HLSQANH | 1977 | 107.848 |
| 702 | GTGCATAATCCTACTACTACG | 761 | VHNPTTT | 1978 | 107.8152 |
| 703 | TCTCAGCGGAATCCGGATGAT | 762 | SQRNPDD | 1979 | 107.784 |
| 704 | AGGGAGACTAATAATTTTGCG | 763 | RETNNFA | 1980 | 107.771 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 705 | AATGCGGGGCTCTTATGGGT | 764 | NAGALMG | 1981 | 107.764 |
| 706 | TTGCCGAAGACTGTGAATATG | 765 | LPKTVNM | 1982 | 107.738 |
| 707 | GCAAGTGACCTACAAATGACG | 766 | ASDLQMT | 1983 | 107.723 |
| 708 | CAAGCCCTGGCCACCACAAAC | 767 | QALATTN | 1984 | 107.716 |
| 709 | CATGAGTCGTCTGGTTATCAT | 768 | HESSGYH | 1985 | 107.696 |
| 710 | GGGGTGAATGATCGTGCTAGG | 769 | GVNDRAR | 1986 | 107.69 |
| 711 | CCTCGGGATGCTCTTCGTACT | 770 | PRDALRT | 1987 | 107.673 |
| 712 | AACGACTCCTCGTCAATGTCC | 771 | NDSSSMS | 1988 | 107.641 |
| 713 | GAATACAACACGCGCCACGAC | 772 | EYNTRHD | 1989 | 107.611 |
| 714 | GCGTCTCCGGCGCATACGTCT | 773 | ASPAHTS | 1990 | 107.598 |
| 715 | CAAAACAGCAACACTCCCTCA | 774 | QNSNTPS | 1991 | 107.546 |
| 716 | TTGGCAAAACTAGGGAACTAC | 775 | LAKLGNY | 1992 | 107.541 |
| 717 | GCTAGTGATAGGCAGTCTGGT | 776 | ASDRQSG | 1993 | 107.527 |
| 718 | TATCAGAATGGTGTGCTTCCT | 777 | YQNGVLP | 1994 | 107.5199 |
| 719 | AATAAGTTTGGTTATAATCCT | 778 | NKFGYNP | 1995 | 107.513 |
| 720 | AAAAAAACCAACGGAATCCCC | 779 | KKTNGIP | 1996 | 107.5 |
| 721 | GTTAACGACAACCGAGGAAAC | 780 | VNDNRGN | 1997 | 107.4937 |
| 722 | ATGCACACCATAACGGGATCC | 781 | MHTITGS | 1998 | 107.491 |
| 723 | ATTGATGGTGTTCAGAAGCTT | 782 | IDGVQKL | 1999 | 107.489 |
| 724 | GCGCAGGTTAATAATCATGAT | 783 | AQVNNHD | 2000 | 107.489 |
| 725 | GTTTCTTCGCCTAATGGTACG | 784 | VSSPNGT | 2001 | 107.487 |
| 726 | GATTCTGCTCCGAGGGCTATT | 785 | DSAPRAI | 2002 | 107.455 |
| 727 | TCTGCGAGTGATAGTCAGCAT | 786 | SASDSQH | 2003 | 107.455 |
| 728 | TCGGCTCATCAGACGCCGACG | 787 | SAHQTPT | 2004 | 107.427 |
| 729 | GCGACGCTGAATAATAGTTAT | 788 | ATLNNSY | 2005 | 107.411 |
| 730 | GAAGACAGTATGAGATTCTCT | 789 | EDSMRFS | 2006 | 107.407 |
| 731 | GAACGAAACGGACTAATAGAA | 790 | ERNGLIE | 2007 | 107.405 |
| 732 | TTAGTACTTGACTCACGGAAC | 791 | LVLDSRN | 2008 | 107.382 |
| 733 | ACCGTCGAACAAATAAACTCG | 792 | TVEQINS | 2009 | 107.349 |
| 734 | GGGACAGGTACCGTTGGATGG | 793 | GTGTVGW | 2010 | 107.203 |
| 735 | AATCAGCAGCGTATTGATAAT | 794 | NQQRIDN | 2011 | 107.185 |
| 736 | ATCCAAAACGGGGTCCTGCCA | 795 | IQNGVLP | 2012 | 107.184 |
| 737 | GGAGACATCTCAAGCAGAAAC | 796 | GDISSRN | 2013 | 107.1386 |
| 738 | GTCACTGGCACTACCCCGGGA | 797 | VTGTTPG | 2014 | 107.137 |
| 739 | ACAAGGGAATCAATGTCCATC | 798 | TRESMSI | 2015 | 107.071 |
| 740 | CACACTTACTCACAAGCAGAC | 799 | HTYSQAD | 2016 | 107.012 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 741 | TCCAACATGGGCGTAGCCTCT | 800 | SNMGVAS | 2017 | 106.985 |
| 742 | CACGACTTGAACCACGGAAAA | 801 | HDLNHGK | 2018 | 106.942 |
| 743 | CTGTACGGGGAGCACACCAA | 802 | LYGGAHQ | 2019 | 106.904 |
| 744 | AACGTGTACGGAGACGGAATA | 803 | NVYGDGI | 2020 | 106.87 |
| 745 | TCTACTATTAATATGCGTGCG | 804 | STINMRA | 2021 | 106.868 |
| 746 | AAGATGGGGAGTATTGAGGTT | 805 | KMGSIEV | 2022 | 106.864 |
| 747 | TCCGAAACGCGCGCTGGATAC | 806 | SETRAGY | 2023 | 106.85 |
| 748 | AATGTGGGTAATACTCTTGGG | 807 | NVGNTLG | 2024 | 106.842 |
| 749 | ATTGGTGGGACTGATACGCGG | 808 | IGGTDTR | 2025 | 106.786 |
| 750 | GCCGACAAAGGATTCGGCCAC | 809 | ADKGFGH | 2026 | 106.73 |
| 751 | TGGCAGGATCATAATAAGGTG | 810 | WQDHNKV | 2027 | 106.719 |
| 752 | AACTACGGTTCCGGACGAATC | 811 | NYGSGRI | 2028 | 106.701 |
| 753 | ACTCATAAGCAGGTGGATCTT | 812 | THKQVDL | 2029 | 106.695 |
| 754 | CGGCAGAATGATAAGGGTAAT | 813 | RQNDKGN | 2030 | 106.658 |
| 755 | GGTAGGAATGAGAGTCCGGAG | 814 | GRNESPE | 2031 | 106.658 |
| 756 | GTTTTTACTGGGCAGACGGAG | 815 | VFTGQTE | 2032 | 106.632 |
| 757 | TATGTTGATCGTAAGGATAAT | 816 | YVDRKDN | 2033 | 106.631 |
| 758 | AATAATACTTTGAATATTTTG | 817 | NNTLNIL | 2034 | 106.63 |
| 759 | TTGAGCTACAGCATCCAACAC | 818 | LSYSIQH | 2035 | 106.621 |
| 760 | GCTACCAACAGATCGCCCCTA | 819 | ATNRSPL | 2036 | 106.5898 |
| 761 | GTTCACACCGCAGACACAATA | 820 | VHTADTI | 2037 | 106.564 |
| 762 | GGGCATTTGGTTAATATGTCT | 821 | GHLVNMS | 2038 | 106.56 |
| 763 | TTAGACTACACCCCTCAAAAC | 822 | LDYTPQN | 2039 | 106.519 |
| 764 | TCCGCCTCTTACTCCAGGATG | 823 | SASYSRM | 2040 | 106.501 |
| 765 | TCCGGAGCGGCACAAAACCCA | 824 | SGAAQNP | 2041 | 106.499 |
| 766 | AGAAACACACTTGCTGACCTT | 825 | RNTLADL | 2042 | 106.496 |
| 767 | GGTTCTACGGTGTCGGCGCAG | 826 | GSTVSAQ | 2043 | 106.491 |
| 768 | TCTAAGGATAGTACTATGTAT | 827 | SKDSTMY | 2044 | 106.48 |
| 769 | GTGGTGGTTCACACTATCCCA | 828 | VVVHTIP | 2045 | 106.45 |
| 770 | CCACGTACTGTCTCATTGGAC | 829 | PRTVSLD | 2046 | 106.4434 |
| 771 | ATGATGAAGAGTGAGGAGAAT | 830 | MMKSEEN | 2047 | 106.425 |
| 772 | ACCACCGACCGGCCAAACGGA | 831 | TTDRPNG | 2048 | 106.406 |
| 773 | CATAGTCCTCCTACGACTATG | 832 | HSPPTTM | 2049 | 106.376 |
| 774 | GGCCAATGGACAACAGGGACA | 833 | GQWTTGT | 2050 | 106.357 |
| 775 | GACGGTATGAACGGAGTGGGT | 834 | DGMNGVG | 2051 | 106.317 |
| 776 | CTTCATACTGTTGCGAATGAG | 835 | LHTVANE | 2052 | 106.312 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 777 | TATACGTCGCAGACGTCTACG | 836 | YTSQTST | 2053 | 106.2842 |
| 778 | AACTTCTCCGAAATGTCCACA | 837 | NFSEMST | 2054 | 106.27 |
| 779 | ATTAATATTCGTAGTGATTTG | 838 | INIRSDL | 2055 | 106.266 |
| 780 | CCCTCCAACAGTGAAAGATTC | 839 | PSNSERF | 2056 | 106.249 |
| 781 | TATACGAATTATGGGGATCTT | 840 | YTNYGDL | 2057 | 106.241 |
| 782 | GATAAGAGTACGGCGCAGGCG | 841 | DKSTAQA | 2058 | 106.238 |
| 783 | CACACCGACATGGTATCCTCT | 842 | HTDMVSS | 2059 | 106.222 |
| 784 | AACAAAGTCTGTCAATGGAC | 843 | NKSLSMD | 2060 | 106.196 |
| 785 | GGGCACTACGCTACAAACACA | 844 | GHYATNT | 2061 | 106.158 |
| 786 | GTCATCGTATCTACAAAATCA | 845 | VIVSTKS | 2062 | 106.124 |
| 787 | ACTCATAGTCTTATGAATGAT | 846 | THSLMND | 2063 | 106.116 |
| 788 | AACTACCACGGAGACAACGTT | 847 | NYHGDNV | 2064 | 106.106 |
| 789 | CGTGATGATCAGCAGCTTGAT | 848 | RDDQQLD | 2065 | 106.064 |
| 790 | GATGATAAGACTGGTCGGTAT | 849 | DDKTGRY | 2066 | 106.055 |
| 791 | GGGTCGAGCCAACACCACGAA | 850 | GSSQHHE | 2067 | 106.042 |
| 792 | CGTGTTACAGGTGTCTCAACA | 851 | RVTGVST | 2068 | 106.017 |
| 793 | AGTACTGCGTCGGGGCATACT | 852 | STASGHT | 2069 | 106.007 |
| 794 | ACTAACAACCTCTCATACGAA | 853 | TNNLSYE | 2070 | 105.998 |
| 795 | CAGCATAATAGTGCGTCGGCG | 854 | QHNSASA | 2071 | 105.987 |
| 796 | CCGGCTAAGGGTTTTGGTCAT | 855 | PAKGFGH | 2072 | 105.9781 |
| 797 | TGGTACGAAACAATCAGCCCG | 856 | WYETISP | 2073 | 105.959 |
| 798 | ACGGATGCTACGGGGAGGCAT | 857 | TDATGRH | 2074 | 105.942 |
| 799 | ATTCAGGCGAAGAATTCTGAG | 858 | IQAKNSE | 2075 | 105.939 |
| 800 | AGTACTGAGACTAGGGGTGGG | 859 | STETRGG | 2076 | 105.926 |
| 801 | TTCTCAACAAACTCTGTAATC | 860 | FSTNSVI | 2077 | 105.918 |
| 802 | TCTAACCTTCGAAACACAATA | 861 | SNLRNTI | 2078 | 105.854 |
| 803 | GGGATGATCGGGCACAACGCA | 862 | GMIGHNA | 2079 | 105.832 |
| 804 | TCTGGCCAAGGATTCTCGGCA | 863 | SGQGFSA | 2080 | 105.831 |
| 805 | ACCCACAACTCTACAGGCCTT | 864 | THNSTGL | 2081 | 105.802 |
| 806 | AGGATTGATAGTGCTATGGTG | 865 | RIDSAMV | 2082 | 105.8 |
| 807 | GTCGCTATGGGAGGCGGTCCC | 866 | VAMGGGP | 2083 | 105.795 |
| 808 | GGCTCTCACAACGGCCCAGCC | 867 | GSHNGPA | 2084 | 105.763 |
| 809 | CACTCCGCAGCGGGTGACGGT | 868 | HSAAGDG | 2085 | 105.73 |
| 810 | GCACAAGGCATAACCCACGCT | 869 | AQGITHA | 2086 | 105.711 |
| 811 | TCTGCGCTTTTGCGGATGGAT | 870 | SALLRMD | 2087 | 105.707 |
| 812 | TGGCAAATGGGGGCCGGGAGC | 871 | WQMGAGS | 2088 | 105.698 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 813 | ATAGACTCGCACGCCAGCATA | 872 | IDSHASI | 2089 | 105.695 |
| 814 | AGCCTAGACCACGCCCCTCTA | 873 | SLDHAPL | 2090 | 105.661 |
| 815 | GAAAACAACATGCAACACGGC | 874 | ENNMQHG | 2091 | 105.651 |
| 816 | AAGGGTGCGCAGGGTGTTCAG | 875 | KGAQGVQ | 2092 | 105.646 |
| 817 | GTCGCTGTATCGAACACTCCA | 876 | VAVSNTP | 2093 | 105.643 |
| 818 | GTTGAGTCTTCTTATTCTCGG | 877 | VESSYSR | 2094 | 105.633 |
| 819 | CATAATACGGAGTCTAAGACT | 878 | HNTESKT | 2095 | 105.625 |
| 820 | AATGAGAGTACGAAGGAGAGT | 879 | NESTKES | 2096 | 105.599 |
| 821 | GATGTTTATCTTAAGAGTCCG | 880 | DVYLKSP | 2097 | 105.586 |
| 822 | CAGTCGGGGGCTAGGACTCTG | 881 | QSGARTL | 2098 | 105.5854 |
| 823 | TCGAACAGTCAAGTACACAAC | 882 | SNSQVHN | 2099 | 105.573 |
| 824 | GTAGTCTCATCGGGCGGCTGG | 883 | VVSSGGW | 2100 | 105.551 |
| 825 | CCATCAAGTTTCAACAGCGCC | 884 | PSSFNSA | 2101 | 105.542 |
| 826 | AAGCAGACTGATAGTAGGGGT | 885 | KQTDSRG | 2102 | 105.5 |
| 827 | AACACAACGCCACCTAACCAC | 886 | NTTPPNH | 2103 | 105.483 |
| 828 | CAAAACGGAACCTCGTCTATA | 887 | QNGTSSI | 2104 | 105.483 |
| 829 | CTCATGAAAGACATGGAATCC | 888 | LMKDMES | 2105 | 105.458 |
| 830 | ACTCAGACTGGTCATGTTTCT | 889 | TQTGHVS | 2106 | 105.4558 |
| 831 | GAAATACACACGACCACAGGC | 890 | EIHTTTG | 2107 | 105.449 |
| 832 | ATACAAACTACTACAAAATGC | 891 | IQTTTKC | 2108 | 105.442 |
| 833 | CCCGCTGAAGGAAACAACCGT | 892 | PAEGNNR | 2109 | 105.442 |
| 834 | TACATCGCCGGAGGGGAACAA | 893 | YIAGGEQ | 2110 | 105.415 |
| 835 | GAAGTACGCGACCAAAAAACA | 894 | EVRDQKT | 2111 | 105.375 |
| 836 | TACGCCGTCGCGATAGGCACA | 895 | YAVAIGT | 2112 | 105.366 |
| 837 | TCCGCTAACGAACACAACCAC | 896 | SANEHNH | 2113 | 105.337 |
| 838 | GGGATGAGGGATACGCCGCCG | 897 | GMRDTPP | 2114 | 105.322 |
| 839 | GCTCAGCAGATTGTTAATGGG | 898 | AQQIVNG | 2115 | 105.321 |
| 840 | TCAAGTTCCCAAACGGTTTTG | 899 | SSSQTVL | 2116 | 105.321 |
| 841 | GTTATTCAGTCTGATAATACG | 900 | VIQSDNT | 2117 | 105.32 |
| 842 | GTTCCGGCGCATTCTCGGGGT | 901 | VPAHSRG | 2118 | 105.305 |
| 843 | TCGAATACGGGTCGTTGGGT | 902 | SNTGSLG | 2119 | 105.2779 |
| 844 | TGGGCCAAAGACGTCAACGTC | 903 | WAKDVNV | 2120 | 105.273 |
| 845 | AATGTGTTGGGTGCTTCGAGT | 904 | NVLGASS | 2121 | 105.187 |
| 846 | ACTCCGGAGGCTAGTGCGCGT | 905 | TPEASAR | 2122 | 105.173 |
| 847 | AATTATAATGGGGTTAATGTG | 906 | NYNGVNV | 2123 | 105.152 |
| 848 | AACACAACCGGTAGCTCGGGC | 907 | NTTGSSG | 2124 | 105.145 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 849 | TCCAGCGGCCAACCGCTCGTC | 908 | SSGQPLV | 2125 | 105.136 |
| 850 | CAGGCGGGGGGTGTGGCGAGT | 909 | QAGGVAS | 2126 | 105.133 |
| 851 | CCGCTTCAATCCCAATCGGGA | 910 | PLQSQSG | 2127 | 105.133 |
| 852 | CAACGTACCTCGGAAGCGCCA | 911 | QRTSEAP | 2128 | 105.128 |
| 853 | TTGGCTAAGACGGTTGCGATT | 912 | LAKTVAI | 2129 | 105.1155 |
| 854 | ACCCACACCCTTGGGGGAACA | 913 | THTLGGT | 2130 | 105.08 |
| 855 | CACGACTACAGTATGAACGCG | 914 | HDYSMNA | 2131 | 105.079 |
| 856 | GGGAAACCTGCGGAAGCGCCG | 915 | GKPAEAP | 2132 | 105.055 |
| 857 | AGAAACGAAAACGTAAACGCT | 916 | RNENVNA | 2133 | 105.051 |
| 858 | AGTTCTCGGGAGGCGAAGTTT | 917 | SSREAKF | 2134 | 105.0379 |
| 859 | TCTTCTTCTGATAGTCCGCGT | 918 | SSSDSPR | 2135 | 105.035 |
| 860 | ATGAATACGACTTATAATGAG | 919 | MNTTYNE | 2136 | 105.031 |
| 861 | GTAAGGAGTGGAATAAAACCA | 920 | VRSGIKP | 2137 | 105.008 |
| 862 | CAGGAGAATCCTATGAAGATG | 921 | QENPMKM | 2138 | 104.926 |
| 863 | ACTGAGCCGCTTCCGATGTCT | 922 | TEPLPMS | 2139 | 104.869 |
| 864 | CGCCACGGGGACACACCGATG | 923 | RHGDTPM | 2140 | 104.844 |
| 865 | GCGGTGAATACGTATAATAGT | 924 | AVNTYNS | 2141 | 104.82 |
| 866 | GCGTCGACTGAGTCTCATGTG | 925 | ASTESHV | 2142 | 104.816 |
| 867 | ACAAACCTAAGTCAATCGGCC | 926 | TNLSQSA | 2143 | 104.791 |
| 868 | GAGCTGTCTACTCCTATGGTT | 927 | ELSTPMV | 2144 | 104.783 |
| 869 | TATGCGCATCCTGTGACTCAT | 928 | YAHPVTH | 2145 | 104.76 |
| 870 | CGGGGGTCTACTGGTACGCAG | 929 | RGSTGTQ | 2146 | 104.749 |
| 871 | TGTGTTGGTTCGTGTGGTGTG | 930 | CVGSCGV | 2147 | 104.738 |
| 872 | TCGGTTGCTAAGGATCAGACG | 931 | SVAKDQT | 2148 | 104.736 |
| 873 | ACGAATCTTTCTCCTAAGACG | 932 | TNLSPKT | 2149 | 104.6855 |
| 874 | CTAGGTTTCACACCCCAACCG | 933 | LGFTPQP | 2150 | 104.677 |
| 875 | AATATTAGTAGTATTAATCAG | 934 | NISSINQ | 2151 | 104.657 |
| 876 | GTTTACGACAACGTTTCTTCT | 935 | VYDNVSS | 2152 | 104.657 |
| 877 | AGTGGAAAACAAGACAAATAC | 936 | SGKQDKY | 2153 | 104.654 |
| 878 | AGACTTACAGAACTGGTCATA | 937 | RLTELVI | 2154 | 104.651 |
| 879 | CATAAGAGTGAGAGTCATAAT | 938 | HKSESHN | 2155 | 104.626 |
| 880 | GAGGCGACTCATGGTTCTTAT | 939 | EATHGSY | 2156 | 104.613 |
| 881 | AACCTACTTGTCGACCAACGT | 940 | NLLVDQR | 2157 | 104.579 |
| 882 | AATATTAATGATACTAAGAAT | 941 | NINDTKN | 2158 | 104.522 |
| 883 | CTTGCGGTTACGAATGTGCGG | 942 | LAVTNVR | 2159 | 104.498 |
| 884 | CCGTCGACACTCGCTGAAACA | 943 | PSTLAET | 2160 | 104.449 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 885 | CCGAAGCCTGGGACGGGGAG | 944 | PKPGTGE | 2161 | 104.427 |
| 886 | GTGCTGTTGCAGAATTCTCAT | 945 | VLLQNSH | 2162 | 104.416 |
| 887 | TACGGTAACGCGAACACCGTA | 946 | YGNANTV | 2163 | 104.386 |
| 888 | ACATCTGGAGTTCTGACACGC | 947 | TSGVLTR | 2164 | 104.375 |
| 889 | AAAATAACGGAAACCAACCTC | 948 | KITETNL | 2165 | 104.359 |
| 890 | GTTCGCAGAGACGAAACACCT | 949 | VRRDETP | 2166 | 104.359 |
| 891 | TCTAAAATGTCAAACCCAGTG | 950 | SKMSNPV | 2167 | 104.352 |
| 892 | TGGGAATCCCTCTCCAACGCA | 951 | WESLSNA | 2168 | 104.349 |
| 893 | GCCAACGGAGGAGGATACCCC | 952 | ANGGGYP | 2169 | 104.34 |
| 894 | ATGTTGGCTTCTCGGGTGCCT | 953 | MLASRVP | 2170 | 104.336 |
| 895 | TGCGGCCTGAACTGCGGTAAA | 954 | CGLNCGK | 2171 | 104.331 |
| 896 | ACTATTACTAGTCCGTCGGTG | 955 | TITSPSV | 2172 | 104.3055 |
| 897 | TGGTCGAATGCTCAGAGTCCG | 956 | WSNAQSP | 2173 | 104.288 |
| 898 | ACAGAAAGCCCCAAACTACTA | 957 | TESPKLL | 2174 | 104.283 |
| 899 | CATTTGGTTACTAGTGGTATT | 958 | HLVTSGI | 2175 | 104.273 |
| 900 | CCTCCTAAGTCGGATTCGAAT | 959 | PPKSDSN | 2176 | 104.265 |
| 901 | ATTGCGGTGCATGTGCTGAGT | 960 | IAVHVLS | 2177 | 104.254 |
| 902 | ACTGGTACTGCGACTTTGCCT | 961 | TGTATLP | 2178 | 104.254 |
| 903 | AATACTACTCCGCCTAATCAT | 962 | NTTPPNH | 2179 | 104.232 |
| 904 | TGCACCGCCACAAAATGCTCA | 963 | CTATKCS | 2180 | 104.23 |
| 905 | CACAGTGACATGGTCAGCGGC | 964 | HSDMVSG | 2181 | 104.208 |
| 906 | CCAAACGCACACCACCTGCCC | 965 | PNAHHLP | 2182 | 104.2 |
| 907 | TCTAATAATATGAATCAGGCG | 966 | SNNMNQA | 2183 | 104.187 |
| 908 | AGTGATAATAATAGGGCTAAT | 967 | SDNNRAN | 2184 | 104.1865 |
| 909 | TTGCAGACGCCTGGGACGACG | 968 | LQTPGTT | 2185 | 104.169 |
| 910 | GTGCGCGGCGTTCAAGACGCC | 969 | VRGVQDA | 2186 | 104.167 |
| 911 | TCTCTAGACTCGCGCTCCTCG | 970 | SLDSRSS | 2187 | 104.14 |
| 912 | GTTTGTGTTACTACTTGTGCT | 971 | VCVTTCA | 2188 | 104.137 |
| 913 | CCGAATACTAATCATCTTGTG | 972 | PNTNHLV | 2189 | 104.121 |
| 914 | CTCATGTCAGGGAAAGAAAAC | 973 | LMSGKEN | 2190 | 104.109 |
| 915 | ACTTCTGCTAGTGAGAATTGG | 974 | TSASENW | 2191 | 104.108 |
| 916 | TTTTTGCCGCAGCTGGGGCAG | 975 | FLPQLGQ | 2192 | 104.094 |
| 917 | CCTTTTAATCCTGGGAATGTG | 976 | PFNPGNV | 2193 | 104.0922 |
| 918 | GGGACACCTGGTCAAAGTATA | 977 | GTPGQSI | 2194 | 104.092 |
| 919 | TATAATAATGGTGGGCATGTT | 978 | YNNGGHV | 2195 | 104.085 |
| 920 | CTCGGAAACCACTACACACCC | 979 | LGNHYTP | 2196 | 104.064 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 921 | CAAGTCAACCAACCGAGAATA | 980 | QVNQPRI | 2197 | 104.061 |
| 922 | TTAGGAAACAACCGGCCACTA | 981 | LGNNRPL | 2198 | 104.06 |
| 923 | CCTCCGGAAAGTGCCAGGGGC | 982 | PPESARG | 2199 | 104.023 |
| 924 | AAATCTGTAGGCGACGGGAGA | 983 | KSVGDGR | 2200 | 104.0009 |
| 925 | TCACTTCGGACGGACGAATTC | 984 | SLRTDEF | 2201 | 103.997 |
| 926 | AGTACTACTAATGTTGCGTAT | 985 | STTNVAY | 2202 | 103.987 |
| 927 | AGGATGTCGGATCCTAGTGAT | 986 | RMSDPSD | 2203 | 103.981 |
| 928 | AGTCTGTCTATTACTTCGGCG | 987 | SLSITSA | 2204 | 103.963 |
| 929 | GAAAGTGCCACATCTCTAAAA | 988 | ESATSLK | 2205 | 103.954 |
| 930 | TACACTGACGGAAGAAACACC | 989 | YTDGRNT | 2206 | 103.949 |
| 931 | TCCATATCCAACCTGCGTACC | 990 | SISNLRT | 2207 | 103.935 |
| 932 | CAAAACGACAAATCTGACAAC | 991 | QNDKSDN | 2208 | 103.9165 |
| 933 | GGTGGAACAGGTCTTTCCAAA | 992 | GGTGLSK | 2209 | 103.916 |
| 934 | AGTCAGGCTCAGATTCGTGTT | 993 | SQAQIRV | 2210 | 103.915 |
| 935 | GGTTTGATGGCGCATGTGACT | 994 | GLMAHVT | 2211 | 103.877 |
| 936 | CTGGTTGTTTCGAATAGTCTG | 995 | LVVSNSL | 2212 | 103.865 |
| 937 | CATGATTCTGTGAATACGGCG | 996 | HDSVNTA | 2213 | 103.8588 |
| 938 | ACTCTTGCGAAGGATGGGAAT | 997 | TLAKDGN | 2214 | 103.842 |
| 939 | TCCGACGGATCGAAACTACTA | 998 | SDGSKLL | 2215 | 103.829 |
| 940 | ATAGACAAAACGTTCTCGGTC | 999 | IDKTFSV | 2216 | 103.812 |
| 941 | CGGCTGGTTAACATCGACCAC | 1000 | RLVNIDH | 2217 | 103.8026 |
| 942 | AAAAACTACGACAGTGACTCA | 1001 | KNYDSDS | 2218 | 103.794 |
| 943 | AGTACGCAGAGTACTAATCCG | 1002 | STQSTNP | 2219 | 103.7868 |
| 944 | CAAATATCACTACAACTCGGC | 1003 | QISLQLG | 2220 | 103.77 |
| 945 | TCCGAACCCCTTAGAGTTGGA | 1004 | SEPLRVG | 2221 | 103.749 |
| 946 | AGTCGTCTGCAGACTCAGCAG | 1005 | SRLQTQQ | 2222 | 103.7406 |
| 947 | GAAGGTTCACAAGGAAACCAC | 1006 | EGSQGNH | 2223 | 103.739 |
| 948 | CGTTCTGACCTTACTGAAAGT | 1007 | RSDLTES | 2224 | 103.736 |
| 949 | CATACTGGTGTTCAGACTAAT | 1008 | HTGVQTN | 2225 | 103.724 |
| 950 | GAGTTGGATCATCTTTCGCAT | 1009 | ELDHLSH | 2226 | 103.714 |
| 951 | GTTACTGGTGTTGATTATGCG | 1010 | VTGVDYA | 2227 | 103.713 |
| 952 | GGCGGCGCACACACTCGTGTA | 1011 | GGAHTRV | 2228 | 103.676 |
| 953 | GCCTACGGTATACACGAAGTG | 1012 | AYGIHEV | 2229 | 103.653 |
| 954 | GCGATGCTGCGTATGGAGCAG | 1013 | AMLRMEQ | 2230 | 103.652 |
| 955 | AGGCAGGCGAATCAGACGTAT | 1014 | RQANQTY | 2231 | 103.652 |
| 956 | TTTTCTGGTCAGGCGTTGGCT | 1015 | FSGQALA | 2232 | 103.646 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 957 | GATAATGTGAATTCTCAGCCT | 1016 | DNVNSQP | 2233 | 103.646 |
| 958 | GGGTTGCATGGGACGAGTAAT | 1017 | GLHGTSN | 2234 | 103.633 |
| 959 | GAGAGGGAGCCTCCTAAGAAT | 1018 | EREPPKN | 2235 | 103.621 |
| 960 | GTGGTGACGCTTGGGATGCTG | 1019 | VVTLGML | 2236 | 103.619 |
| 961 | CATAATAATAATTTGCTGAAT | 1020 | HNNNLLN | 2237 | 103.612 |
| 962 | TTGATTAATATGAGTCAGAAT | 1021 | LINMSQN | 2238 | 103.6 |
| 963 | AATACTAATGCGTCGTATTCT | 1022 | NTNASYS | 2239 | 103.599 |
| 964 | AGGCTTAATGCGGGTGAGCAT | 1023 | RLNAGEH | 2240 | 103.594 |
| 965 | GCTGTTATTCTGAATCCTGTT | 1024 | AVILNPV | 2241 | 103.576 |
| 966 | CCGAGTACTCATGGGTATGTT | 1025 | PSTHGYV | 2242 | 103.571 |
| 967 | CTTAGGGCGTCTGTGTCGGAG | 1026 | LRASVSE | 2243 | 103.564 |
| 968 | ATGATGACCTCTATGACGTTA | 1027 | MMTSMTL | 2244 | 103.561 |
| 969 | TCGGCACACAACATAGTATAC | 1028 | SAHNIVY | 2245 | 103.556 |
| 970 | CACGACAGCACAACCCGCCCA | 1029 | HDSTTRP | 2246 | 103.545 |
| 971 | ATCAAAGACTCGTACCTTACT | 1030 | IKDSYLT | 2247 | 103.542 |
| 972 | TATACGCCTGGGCTTACTGAG | 1031 | YTPGLTE | 2248 | 103.541 |
| 973 | AAGATGGGTGGTTCTCAGAGT | 1032 | KMGGSQS | 2249 | 103.477 |
| 974 | TCACGTCAAACAGCGCTAACA | 1033 | SRQTALT | 2250 | 103.4599 |
| 975 | GTAGAAACCAGCAGATTGTAC | 1034 | VETSRLY | 2251 | 103.45 |
| 976 | AAATCCAACAACGGGGAATAC | 1035 | KSNNGEY | 2252 | 103.424 |
| 977 | TCGGGTGTTCATAGTGCGCGT | 1036 | SGVHSAR | 2253 | 103.3881 |
| 978 | CCTAACAACGAAAAAAACCCG | 1037 | PNNEKNP | 2254 | 103.326 |
| 979 | ACTATTGGTGAGGGGTATCAT | 1038 | TIGEGYH | 2255 | 103.325 |
| 980 | CTGCAGACTTCTGTTGCTACT | 1039 | LQTSVAT | 2256 | 103.316 |
| 981 | CTATTGGGAAACGCACCCACA | 1040 | LLGNAPT | 2257 | 103.308 |
| 982 | ATTTCGGGGTCTCATTTGAAT | 1041 | ISGSHLN | 2258 | 103.297 |
| 983 | AAGTCTCTTAGTAGTGATGAT | 1042 | KSLSSDD | 2259 | 103.285 |
| 984 | ACGAGGACTCAGGGGACGTCT | 1043 | TRTQGTS | 2260 | 103.2635 |
| 985 | GTTAGTAGGTCTGGGAGTACT | 1044 | VSRSGST | 2261 | 103.257 |
| 986 | AGCGCCGACACCCGGTCCCCC | 1045 | SADTRSP | 2262 | 103.242 |
| 987 | CGTGATACTGCTAATGGGCCG | 1046 | RDTANGP | 2263 | 103.2389 |
| 988 | ATGATGTCTAACAGCCTCGCG | 1047 | MMSNSLA | 2264 | 103.232 |
| 989 | ACTGGGAGGATTGAGCTTAGG | 1048 | TGRIELR | 2265 | 103.214 |
| 990 | GCTAATAATGCGGCTGCGTCG | 1049 | ANNAAAS | 2266 | 103.209 |
| 991 | CAGTTGAATATTAATGATAAG | 1050 | QLNINDK | 2267 | 103.208 |
| 992 | ATGGACGGGGCTCACACGTCA | 1051 | MDGAHTS | 2268 | 103.202 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 993 | ACTAGTGCGACTGATTCGATG | 1052 | TSATDSM | 2269 | 103.197 |
| 994 | GCCGCCAGCTTGTCGCAAAGC | 1053 | AASLSQS | 2270 | 103.152 |
| 995 | TCTCAGGCGGGTCTGCTTGTG | 1054 | SQAGLLV | 2271 | 103.116 |
| 996 | ACGACTTATTCGGATCTGAGT | 1055 | TTYSDLS | 2272 | 103.104 |
| 997 | TTCTCCTCCGGAACAACCATA | 1056 | FSSGTTI | 2273 | 103.102 |
| 998 | GTCTTCACAGAAATAGAATCG | 1057 | VFTEIES | 2274 | 103.101 |
| 999 | GCAGACCCCGCTAAAGGCAAA | 1058 | ADPAKGK | 2275 | 103.083 |
| 1000 | AAAGAATCTGAATACAGAGTT | 1059 | KESEYRV | 2276 | 103.07 |
| 1001 | GGGATGGTGTCTCTTAATAGG | 1060 | GMVSLNR | 2277 | 103.06 |
| 1002 | ACCGTTATCGAACGCAAAGAC | 1061 | TVIERKD | 2278 | 103.0575 |
| 1003 | AGGATTGATACGTTGTTGGTG | 1062 | RIDTLLV | 2279 | 103.055 |
| 1004 | GGATCCACAGGCCTACCCCCG | 1063 | GSTGLPP | 2280 | 103.047 |
| 1005 | ATGGAGTTGACTTCTACTAGT | 1064 | MELTSTS | 2281 | 103.026 |
| 1006 | CAACCAGGAGCCCCCCAAACC | 1065 | QPGAPQT | 2282 | 103.014 |
| 1007 | AATTCGATGGGTAATGGGGGT | 1066 | NSMGNGG | 2283 | 103.009 |
| 1008 | GGTAGTACTAAGTCTGGGCAG | 1067 | GSTKSGQ | 2284 | 103.0049 |
| 1009 | ACTTTTTTGCCTCAGCTTGGG | 1068 | TFLPQLG | 2285 | 102.994 |
| 1010 | ATGGGAATAAACGTACTGAGC | 1069 | MGINVLS | 2286 | 102.986 |
| 1011 | GTGAATCTTGGTATTTCGGGG | 1070 | VNLGISG | 2287 | 102.985 |
| 1012 | AGTGAGAATCGGGCTGGTAAT | 1071 | SENRAGN | 2288 | 102.945 |
| 1013 | CACTCCAACGCGACTACGATA | 1072 | HSNATTI | 2289 | 102.916 |
| 1014 | CCGGGGTCGTCCGCTTCCATC | 1073 | PGSSASI | 2290 | 102.914 |
| 1015 | ATTACGTCGTTGAATGGGATG | 1074 | ITSLNGM | 2291 | 102.909 |
| 1016 | TATCTGGAGGGTGCTCATCGT | 1075 | YLEGAHR | 2292 | 102.896 |
| 1017 | AGGCAGGTTGAGCAGTCTGAT | 1076 | RQVEQSD | 2293 | 102.889 |
| 1018 | AGCTCTCAAAGTTCCGGGTCG | 1077 | SSQSSGS | 2294 | 102.8836 |
| 1019 | CAGCTTACTGTTGGGAAGCCG | 1078 | QLTVGKP | 2295 | 102.8762 |
| 1020 | GTTGTGCATTCGAGTATTACT | 1079 | VVHSSIT | 2296 | 102.8257 |
| 1021 | CTAGAACAACTACGGGTCCCA | 1080 | LEQLRVP | 2297 | 102.815 |
| 1022 | CAGCATTCTCCGAAGCCGGTT | 1081 | QHSPKPV | 2298 | 102.81 |
| 1023 | GCGGGCAGTTCGCCATCACGC | 1082 | AGSSPSR | 2299 | 102.8035 |
| 1024 | GGAGTAACAATCGGTAGCAGG | 1083 | GVTIGSR | 2300 | 102.7752 |
| 1025 | TACATCGCGGGAGGCGACCAA | 1084 | YIAGGDQ | 2301 | 102.75 |
| 1026 | ATTAGTAGTGAGAGGTTTTCT | 1085 | ISSERFS | 2302 | 102.729 |
| 1027 | AGGAGTGAGGGTAATCATGCT | 1086 | RSEGNHA | 2303 | 102.719 |
| 1028 | GAGAAGGGGAATAGTGGGGTT | 1087 | EKGNSGV | 2304 | 102.71 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 1029 | TACATAGTTGACCACGCTAAC | 1088 | YIVDHAN | 2305 | 102.71 |
| 1030 | CGTCGGTTGAGTACGGATCTT | 1089 | RRLSTDL | 2306 | 102.702 |
| 1031 | GCGAATAGTAGGCTTGGGGCG | 1090 | ANSRLGA | 2307 | 102.6979 |
| 1032 | GGTACTGCTGAGAATACGAGT | 1091 | GTAENTS | 2308 | 102.696 |
| 1033 | GTGAGGGATGTTGCTAAGGAG | 1092 | VRDVAKE | 2309 | 102.691 |
| 1034 | GGAGGCCTTACCAACGGTCTA | 1093 | GGLTNGL | 2310 | 102.67 |
| 1035 | CCTTCGATTCCGTCGTTTTCG | 1094 | PSIPSFS | 2311 | 102.657 |
| 1036 | AACGCTCTCCTCAACGCACCT | 1095 | NALLNAP | 2312 | 102.628 |
| 1037 | GACGACATGGTCAAAAACTCA | 1096 | DDMVKNS | 2313 | 102.623 |
| 1038 | ACTGCGAATACGCATGCTCTG | 1097 | TANTHAL | 2314 | 102.613 |
| 1039 | GTATACGCCACCGCACTCGCA | 1098 | VYATALA | 2315 | 102.611 |
| 1040 | GGTATATACCCGGCATCCACC | 1099 | GIYPAST | 2316 | 102.61 |
| 1041 | GGTTTTGATGGTAAGCAGCTT | 1100 | GFDGKQL | 2317 | 102.606 |
| 1042 | CACTCTATGTCCGCAAACACC | 1101 | HSMSANT | 2318 | 102.605 |
| 1043 | TGGAGCATCAAAAACCAAACA | 1102 | WSIKNQT | 2319 | 102.586 |
| 1044 | ACCCTCCACACCAAAGACCTA | 1103 | TLHTKDL | 2320 | 102.57 |
| 1045 | TCTTATGGTAATACTCATGAT | 1104 | SYGNTHD | 2321 | 102.566 |
| 1046 | CAGTCGGGGTCTCTGGTGCCG | 1105 | QSGSLVP | 2322 | 102.552 |
| 1047 | AATACTTTGCAGAATAGTCAT | 1106 | NTLQNSH | 2323 | 102.5506 |
| 1048 | ACGGCTGAGTCTAGTCATCCG | 1107 | TAESSHP | 2324 | 102.548 |
| 1049 | GCCTCTACAGTCTCACTCTAC | 1108 | ASTVSLY | 2325 | 102.547 |
| 1050 | CTGACTGCTGTTGCGATTAGT | 1109 | LTAVAIS | 2326 | 102.542 |
| 1051 | GTCTCGGGACAAAGTGCGTAC | 1110 | VSGQSAY | 2327 | 102.541 |
| 1052 | GGTGAAACTAACTTCCCAACT | 1111 | GETNFPT | 2328 | 102.532 |
| 1053 | AATGATAATAGGTCGATGAAT | 1112 | NDNRSMN | 2329 | 102.526 |
| 1054 | CGATCAGGCGACCCTAAAAAC | 1113 | RSGDPKN | 2330 | 102.519 |
| 1055 | TGGGAGAGTGATAAGTTTCGT | 1114 | WESDKFR | 2331 | 102.514 |
| 1056 | CAGGTTAATCATAATACTAGT | 1115 | QVNHNTS | 2332 | 102.514 |
| 1057 | GGGTGGTCGAACAACGAACTA | 1116 | GWSNNEL | 2333 | 102.507 |
| 1058 | CGGGCTGTGCTTGCGACTAAT | 1117 | RAVLATN | 2334 | 102.49 |
| 1059 | CATATGGGTTTGAATGAGCTT | 1118 | HMGLNEL | 2335 | 102.484 |
| 1060 | GGAGAAAGCTCCTCAATAAGC | 1119 | GESSSIS | 2336 | 102.477 |
| 1061 | ATACACAAATCTAGCGTCGAA | 1120 | IHKSSVE | 2337 | 102.473 |
| 1062 | ATGTCCGGATCCATGATATCA | 1121 | MSGSMIS | 2338 | 102.463 |
| 1063 | TTGAGTCTGGCTGGGAATAGG | 1122 | LSLAGNR | 2339 | 102.448 |
| 1064 | TCTGCAACAACGAACCACGGA | 1123 | SATTNHG | 2340 | 102.441 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 1065 | TCTACGGAGTCTAATGCTAGT | 1124 | STESNAS | 2341 | 102.43 |
| 1066 | CCGATTGCTGAGAGGCCTTCT | 1125 | PIAERPS | 2342 | 102.428 |
| 1067 | TTACTTCCAAACAACACCCAC | 1126 | LLPNNTH | 2343 | 102.424 |
| 1068 | GGGACTCTTAAGAAGGATGCG | 1127 | GTLKKDA | 2344 | 102.412 |
| 1069 | GCTCTTGAGAATCGGAGTCTG | 1128 | ALENRSL | 2345 | 102.408 |
| 1070 | ACCACCGGGAACTCCACGATG | 1129 | TTGNSTM | 2346 | 102.383 |
| 1071 | GTGTATGATAGTGCGCCTAAT | 1130 | VYDSAPN | 2347 | 102.366 |
| 1072 | CTACTATCTAAAGGGGACTCC | 1131 | LLSKGDS | 2348 | 102.346 |
| 1073 | TCTTACGCCATAAACCAATCA | 1132 | SYAINQS | 2349 | 102.335 |
| 1074 | GGAGGAGGGGAACGTTCCACG | 1133 | GGGERST | 2350 | 102.323 |
| 1075 | ATTCAGGTTAGTGGTAGTCAG | 1134 | IQVSGSQ | 2351 | 102.315 |
| 1076 | TATCCTGTTTCGCTTTCGCCG | 1135 | YPVSLSP | 2352 | 102.312 |
| 1077 | GAGTTGGGTAATAAGACGGCT | 1136 | ELGNKTA | 2353 | 102.311 |
| 1078 | TCGGGGTAAACTTCGGAGTA | 1137 | SGVNFGV | 2354 | 102.287 |
| 1079 | GCGTGGAGTTCGCCGAGTGGG | 1138 | AWSPSG | 2355 | 102.285 |
| 1080 | GGTGTGAATTATCATACTACG | 1139 | GVNYHTT | 2356 | 102.261 |
| 1081 | CTGATTGGGGAGCTTAAGATG | 1140 | LIGELKM | 2357 | 102.255 |
| 1082 | TATCTGAATAGTAAGCAGCTT | 1141 | YLNSKQL | 2358 | 102.212 |
| 1083 | ACTGTTGATAGGCCGATTGTG | 1142 | TVDRPIV | 2359 | 102.191 |
| 1084 | GTCAGCAAAACCAAAGACTCG | 1143 | VSKTKDS | 2360 | 102.184 |
| 1085 | CAAGCTGGGAACGCGCCAAGG | 1144 | QAGNAPR | 2361 | 102.1806 |
| 1086 | CAAGACCAAACGAGCAACCGT | 1145 | QDQTSNR | 2362 | 102.177 |
| 1087 | GATACTACGTATCGGAATACT | 1146 | DTTYRNT | 2363 | 102.173 |
| 1088 | GGGACAACCGAAGTTAACAAA | 1147 | GTTEVNK | 2364 | 102.17 |
| 1089 | GGGTTTACTAATACGAGTAAG | 1148 | GFTNTSK | 2365 | 102.152 |
| 1090 | GTGCAGAAGAATGATGTGCTT | 1149 | VQKNDVL | 2366 | 102.14 |
| 1091 | AGCGTCAACAACATGCGACTC | 1150 | SVNNMRL | 2367 | 102.1324 |
| 1092 | TTCAGTGCCGCCTTACCGTTA | 1151 | FSAALPL | 2368 | 102.13 |
| 1093 | GACGTCCCAAACAACAAAAGG | 1152 | DVPNNKR | 2369 | 102.126 |
| 1094 | GGTGAGACTATGCGTCATAAT | 1153 | GETMRHN | 2370 | 102.119 |
| 1095 | ATTCGGACTTCTGTGATTAAT | 1154 | IRTSVIN | 2371 | 102.103 |
| 1096 | CCGCGTGCTCCTGGTCATAAT | 1155 | PRAPGHN | 2372 | 102.101 |
| 1097 | AGTGTTGCGCATCCTTTGTCT | 1156 | SVAHPLS | 2373 | 102.101 |
| 1098 | ATGACAATAACCGTCGAACCG | 1157 | MTITVEP | 2374 | 102.096 |
| 1099 | CCATTAAACGCGAACGGCTCC | 1158 | PLNANGS | 2375 | 102.094 |
| 1100 | AATAGGCAGCGGGATTTTGAG | 1159 | NRQRDFE | 2376 | 102.073 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 1101 | GATATTCATAATCCGCGTACG | 1160 | DIHNPRT | 2377 | 102.073 |
| 1102 | TGGATAGCAGGAAACCACTCC | 1161 | WIAGNHS | 2378 | 102.07 |
| 1103 | TCTACTCATCATGCTGATCGT | 1162 | STHHADR | 2379 | 102.069 |
| 1104 | CCGGAATCCGCCGCCAAAAGC | 1163 | PESAAKS | 2380 | 102.058 |
| 1105 | CACTCCGACAAAGTCTCCTCA | 1164 | HSDKVSS | 2381 | 102.051 |
| 1106 | TCAAACAGCGCCGACGCGGGG | 1165 | SNSADAG | 2382 | 102.047 |
| 1107 | GAGTTTCAGAGGATTCGTGAG | 1166 | EFQRIRE | 2383 | 102.039 |
| 1108 | TCCGCGGGATGACATTGGAC | 1167 | SAGMTLD | 2384 | 102.016 |
| 1109 | ACTCAAACTTCTACCTGGACC | 1168 | TQTSTWT | 2385 | 102.009 |
| 1110 | ACGACACTAACGCAAACGGAC | 1169 | TTLTQTD | 2386 | 102.003 |
| 1111 | GCCTCGAAAGGCTTCGGCCAC | 1170 | ASKGFGH | 2387 | 101.991 |
| 1112 | CCGGCTACGATGATTAGTGAG | 1171 | PATMISE | 2388 | 101.985 |
| 1113 | ACTGACTCATCTGCAGACTCC | 1172 | TDSSADS | 2389 | 101.981 |
| 1114 | TCAACCAGAAAAGAACACGAC | 1173 | STRKEHD | 2390 | 101.98 |
| 1115 | GGTGATATTTCTTATAGGGTT | 1174 | GDISYRV | 2391 | 101.977 |
| 1116 | ATGGGGTATGTTGATAGTCTG | 1175 | MGYVDSL | 2392 | 101.953 |
| 1117 | CAAACCATCACCTCACAAATG | 1176 | QTITSQM | 2393 | 101.941 |
| 1118 | TCGATTGGGTATTCGCCTCCG | 1177 | SIGYSPP | 2394 | 101.939 |
| 1119 | TCATCCCCAGACTCGTACAGA | 1178 | SSPDSYR | 2395 | 101.921 |
| 1120 | ATTAGTCCGAGTGCTTCTAAT | 1179 | ISPSASN | 2396 | 101.855 |
| 1121 | TATCCGGCTGATCATCGGACT | 1180 | YPADHRT | 2397 | 101.85 |
| 1122 | CACACCGGCCAAACACCATCA | 1181 | HTGQTPS | 2398 | 101.837 |
| 1123 | CAGACGACTATTCTGGCTGCT | 1182 | QTTILAA | 2399 | 101.837 |
| 1124 | GATGGTACGAGGCAGGTTCAT | 1183 | DGTRQVH | 2400 | 101.836 |
| 1125 | AGGAGTAGTCCTGCGACGAAT | 1184 | RSSPATN | 2401 | 101.829 |
| 1126 | GCGATGAGTCATACGTATAAG | 1185 | AMSHTYK | 2402 | 101.813 |
| 1127 | ATGGCGGCTCCGCCGGAGCAT | 1186 | MAAPPEH | 2403 | 101.802 |
| 1128 | GGTCCTAGTACTTCGGAGGCG | 1187 | GPSTSEA | 2404 | 101.794 |
| 1129 | CATAATCATGATAGGTCGTCT | 1188 | HNHDRSS | 2405 | 101.7829 |
| 1130 | GTGGTCCCATCGACCCAAGCA | 1189 | VVPSTQA | 2406 | 101.781 |
| 1131 | ATTCCTGTGACTACTCGTAAT | 1190 | IPVTTRN | 2407 | 101.722 |
| 1132 | AACCAACTCGTACGCGGGACA | 1191 | NQLVRGT | 2408 | 101.717 |
| 1133 | GGGTTTGCGCTTACGGGTACG | 1192 | GFALTGT | 2409 | 101.696 |
| 1134 | TCTAAGGGTGGTGATATGGTG | 1193 | SKGGDMV | 2410 | 101.666 |
| 1135 | GCTCGACCAGGCCAATCTATG | 1194 | ARPGQSM | 2411 | 101.6287 |
| 1136 | AAAGCAGACTACGAATCCTCC | 1195 | KADYESS | 2412 | 101.626 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 1137 | GGACCAAGTTCGCACATCGTT | 1196 | GPSSHIV | 2413 | 101.616 |
| 1138 | GAAGTTGTCAAAACCACGCAC | 1197 | EVVKTTH | 2414 | 101.61 |
| 1139 | ACTTTGGATAATAATCATTCT | 1198 | TLDNNHS | 2415 | 101.604 |
| 1140 | ACGATTTATAATATGGGTCCG | 1199 | TIYNMGP | 2416 | 101.599 |
| 1141 | TCTACCATGAACACGATCACG | 1200 | STMNTIT | 2417 | 101.597 |
| 1142 | ACGCTGGCGCGGACTACTGAG | 1201 | TLARTTE | 2418 | 101.581 |
| 1143 | TTGATTTCTTCGCAGACTTCT | 1202 | LISSQTS | 2419 | 101.553 |
| 1144 | CAGACTGCGTCTGGTGATACT | 1203 | QTASGDT | 2420 | 101.497 |
| 1145 | GCGCATGGTGCTTTTCCGGTT | 1204 | AHGAFPV | 2421 | 101.495 |
| 1146 | GGGGAGACGCGGTCGACTGCT | 1205 | GETRSTA | 2422 | 101.494 |
| 1147 | AACAACTACGCCTACTCCGCT | 1206 | NNYAYSA | 2423 | 101.493 |
| 1148 | GAGGCTTATCAGACTGAGAAG | 1207 | EAYQTEK | 2424 | 101.49 |
| 1149 | TCTCTAGCACACGCCGTAAGC | 1208 | SLAHAVS | 2425 | 101.485 |
| 1150 | ACGTATCAGTTGAGTGGGAAT | 1209 | TYQLSGN | 2426 | 101.452 |
| 1151 | ATGAGCGAAAGGTTGCGGATA | 1210 | MSERLRI | 2427 | 101.431 |
| 1152 | GGGTCGGGGAAAGACCCAGGG | 1211 | GSGKDPG | 2428 | 101.43 |
| 1153 | TACAACAGCAACGCTTCTGTA | 1212 | YNSNASV | 2429 | 101.428 |
| 1154 | ACGAGGGGTGATATGGAGTTT | 1213 | TRGDMEF | 2430 | 101.424 |
| 1155 | GGAATCACCGGAAGCCCCGGC | 1214 | GITGSPG | 2431 | 101.42 |
| 1156 | CAACACACCGCCCACCCCATG | 1215 | QHTAHPM | 2432 | 101.416 |
| 1157 | GATACGGCGAATCGTTCGACT | 1216 | DTANRST | 2433 | 101.407 |
| 1158 | TCGGCACACGACGCAAGACTA | 1217 | SAHDARL | 2434 | 101.387 |
| 1159 | CTTAATCATACTCTGGGGCAT | 1218 | LNHTLGH | 2435 | 101.385 |
| 1160 | GGGTTTGAGACGAGTAGTCCT | 1219 | GFETSSP | 2436 | 101.369 |
| 1161 | GGTACGAGTGCGGAGAGTCGG | 1220 | GTSAESR | 2437 | 101.366 |
| 1162 | CATGCTAATTATGTTGAGGTG | 1221 | HANYVEV | 2438 | 101.345 |
| 1163 | ACAACGAAACCGGTCGCGGAA | 1222 | TTKPVAE | 2439 | 101.338 |
| 1164 | TCGACCGCCGTTACTAACTCA | 1223 | STAVTNS | 2440 | 101.304 |
| 1165 | CTGGGGCTTGCTGGTCAGGTT | 1224 | LGLAGQV | 2441 | 101.304 |
| 1166 | GTGCTTAAGGGTACGTTTCCG | 1225 | VLKGTFP | 2442 | 101.298 |
| 1167 | ATGAATGAGCCTGGTAGGACG | 1226 | MNEPGRT | 2443 | 101.283 |
| 1168 | ACTTCTGATCCTTTGAGGAAT | 1227 | TSDPLRN | 2444 | 101.252 |
| 1169 | CGTGATACTAATACGGATAAG | 1228 | RDTNTDK | 2445 | 101.234 |
| 1170 | GAGTCTGATTTGCGTCAGCGG | 1229 | ESDLRQR | 2446 | 101.225 |
| 1171 | TCCGGAATGGCCGGCCTTTCC | 1230 | SGMAGLS | 2447 | 101.211 |
| 1172 | ATAGCAACAACGTCTGGGCGG | 1231 | IATTSGR | 2448 | 101.21 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 1173 | ACGATTAGGAGTGAGGGTTTT | 1232 | TIRSEGF | 2449 | 101.202 |
| 1174 | GGTCTGTCTATTACTATTGCG | 1233 | GLSITIA | 2450 | 101.176 |
| 1175 | CCGCCTACTAATGGGCGTATG | 1234 | PPTNGRM | 2451 | 101.17 |
| 1176 | CTACAAGACCGGGCAACGAAC | 1235 | LQDRATN | 2452 | 101.165 |
| 1177 | CTTAAATCGACCGGTGACCAC | 1236 | LKSTGDH | 2453 | 101.132 |
| 1178 | GATAATAATAATCAGGTTTAT | 1237 | DNNQVY | 2454 | 101.13 |
| 1179 | GTGCATATGGAGTCGTATGCG | 1238 | VHMESYA | 2455 | 101.111 |
| 1180 | GACCAAATAGGGCACGGAACA | 1239 | DQIGHGT | 2456 | 101.106 |
| 1181 | GGGACGGGGCCGCATGGTACT | 1240 | GTGPHGT | 2457 | 101.0712 |
| 1182 | ATTGGGAATAATACTGGTCTT | 1241 | IGNNTGL | 2458 | 101.0529 |
| 1183 | TTAAACGCAGAATACACCAAC | 1242 | LNAEYTN | 2459 | 101.047 |
| 1184 | GTGACGTCGTCTGCTAGTGGT | 1243 | VTSSASG | 2460 | 101.027 |
| 1185 | ACGCATGTTGCTAAGCCTGAT | 1244 | THVAKPD | 2461 | 101.017 |
| 1186 | CCGATGAACAAAGACATACTG | 1245 | PMNKDIL | 2462 | 100.9906 |
| 1187 | CTTAGTTTGAATATGAATGAG | 1246 | LSLNMNE | 2463 | 100.99 |
| 1188 | GTCGGCAACTCAAGCACTCAC | 1247 | VGNSSTH | 2464 | 100.99 |
| 1189 | GGCCACGGAAGTGACTTGACC | 1248 | GHGSDLT | 2465 | 100.9576 |
| 1190 | CTTACACAAAACCCAACGAAC | 1249 | LTQNPTN | 2466 | 100.934 |
| 1191 | CCGAGTGATCATATGCGGACT | 1250 | PSDHMRT | 2467 | 100.8849 |
| 1192 | CCTGATAGTCGTTTGGCGGCT | 1251 | PDSRLAA | 2468 | 100.843 |
| 1193 | TGGGGTAGTGAGGGGACGATT | 1252 | WGSEGTI | 2469 | 100.84 |
| 1194 | AAACCGACAAACGACTCGTAC | 1253 | KPTNDSY | 2470 | 100.821 |
| 1195 | AACCGCGGAACAGAAGTTTAC | 1254 | NRGTEVY | 2471 | 100.8147 |
| 1196 | CACGTGATCACAACAAAAGAC | 1255 | HVITTKD | 2472 | 100.7896 |
| 1197 | ATTGTGTCTAATCCGCCGGCG | 1256 | IVSNPPA | 2473 | 100.76 |
| 1198 | ATGCGTAACGACCAACAACTT | 1257 | MRNDQQL | 2474 | 100.7503 |
| 1199 | TTTCAGCGTGATGTTGGTCAT | 1258 | FQRDVGH | 2475 | 100.7392 |
| 1200 | GCCAACGACAACACCAAACAA | 1259 | ANDNTKQ | 2476 | 100.7364 |
| 1201 | TCTGTTCCGCATGCGGGGGAT | 1260 | SVPHAGD | 2477 | 100.7276 |
| 1202 | AATGCTACTCCGCCGAATCAT | 1261 | NATPPNH | 2478 | 100.6678 |
| 1203 | TCAGAACACACATCAGTTCTA | 1262 | SEHTSVL | 2479 | 100.64 |
| 1204 | GCCATGTCCCAAACGGACATC | 1263 | AMSQTDI | 2480 | 100.628 |
| 1205 | CCTAAGGCTCCGCTTAATAAT | 1264 | PKAPLNN | 2481 | 100.627 |
| 1206 | ACCAACAACTTACTCGCACAA | 1265 | TNNLLAQ | 2482 | 100.55 |
| 1207 | CAGCGTCAGGGTTCGGGGGTT | 1266 | QRQGSGV | 2483 | 100.5318 |
| 1208 | CGCAGTGACACCACTAACGCC | 1267 | RSDTTNA | 2484 | 100.51 |

TABLE 1-continued

CK8 Results mRNA Second Round of Capsid Variant Selection in C57BL6 mice-score capped at 100

| Variant ID | Nucleotide Sequence | SEQ ID NO: | Amino Acid Sequence | SEQ ID NO: | Sum of muscle mRNA score_capped at 100 |
|---|---|---|---|---|---|
| 1209 | GAGGCTGATAAGAATGGTGTT | 1268 | EADKNGV | 2485 | 100.386 |
| 1210 | ATGCTGGGGGGTTTTGCGCAG | 1269 | MLGGFAQ | 2486 | 100.3622 |
| 1211 | ATGACACACCTCAGCACAGAC | 1270 | MTHLSTD | 2487 | 100.267 |
| 1212 | GTTTTGTCTGATAAGGCGTTT | 1271 | VLSDKAF | 2488 | 100.231 |
| 1213 | ACACCCTCCGGTACCATAAAA | 1272 | TPSGTIK | 2489 | 100.22 |
| 1214 | ATTATTCTTATGGGTCAGAGT | 1273 | IILMGQS | 2490 | 100.213 |
| 1215 | CTTTCGGGGGTGAGACTCTT | 1274 | LSGGETL | 2491 | 100.154 |
| 1216 | ACCGACGGCGCCCTGGGTTAC | 1275 | TDGALGY | 2492 | 100.129 |
| 1217 | GGGAATAAGGCTGCGCTGACG | 1276 | GNKAALT | 2493 | 100.066 |

TABLE 2

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1 | AGAGGAGACTTGACAACCCCA | 2494 | RGDLTTP | 3737 | 576.12 |
| 2 | CGGGGTGATCTTAATCAGTAT | 2495 | RGDLNQY | 3738 | 496.41 |
| 3 | AGGGGTGATCTTTCTACGCCT | 2496 | RGDLSTP | 3739 | 475.909 |
| 4 | CGGGGTGATCAGCTTTATCAT | 2497 | RGDQLYH | 3740 | 460.578 |
| 5 | CGAGGAGACACCATGAGCAAA | 2498 | RGDTMSK | 3741 | 439.771 |
| 6 | AGGGGGGATGCGACGGAGCTT | 2499 | RGDATEL | 3742 | 429.74 |
| 7 | AGAGGCGACTTATCCACACCC | 2500 | RGDLSTP | 3743 | 429.182 |
| 8 | CGCGGCGACATGATAAACACC | 2501 | RGDMINT | 3744 | 397.62 |
| 9 | AGGGGCGACCTGAACCAATAC | 2502 | RGDLNQY | 3745 | 388.417 |
| 10 | CGGGGGGATACTATGTCTAAG | 2503 | RGDTMSK | 3746 | 352.268 |
| 11 | CGGGGTGATCTTACTACGCCT | 2504 | RGDLTTP | 3747 | 320.042 |
| 12 | AGGGGCGACCTCAACGACAGC | 2505 | RGDLNDS | 3748 | 315.615 |
| 13 | GCAAACCCCAACATACTAGAC | 2506 | ANPNILD | 3749 | 302.02 |
| 14 | CGAGGCGACACAATGAACTAC | 2507 | RGDTMNY | 3750 | 285.332 |
| 15 | ATGAGTAATTTGGGGTATGAG | 2508 | MSNLGYE | 3751 | 270.74 |
| 16 | TACACCTCTCAAACCAGCACT | 2509 | YTSQTST | 3752 | 256.544 |
| 17 | CTCGGAGGAAACAGCAGGTTC | 2510 | LGGNSRF | 3753 | 255.425 |
| 18 | CAAAGCCAAGCGATACAACTA | 2511 | QSQAIQL | 3754 | 254.191 |
| 19 | AACACGTACACACCGGGAAAA | 2512 | NTYTPGK | 3755 | 239.565 |
| 20 | GGGGCGGAAGCGGGCCGCCAA | 2513 | GAEAGRQ | 3756 | 237.2829 |
| 21 | GAACACGCTACAGCAAAACAA | 2514 | EHATAKQ | 3757 | 236.826 |
| 22 | GCGGCACAACTCGTCAGTCCA | 2515 | AAQLVSP | 3758 | 225.034 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 23 | GATCAGACGGCTAGTATTGTT | 2516 | DQTASIV | 3759 | 224.832 |
| 24 | GTTCAAACCCACATAGGAGTC | 2517 | VQTHIGV | 3760 | 224.306 |
| 25 | TCTTATGGTAATACTCATGAT | 2518 | SYGNTHD | 3761 | 224.26 |
| 26 | ACCTCCACGGCTTCAAAACAA | 2519 | TSTASKQ | 3762 | 221.617 |
| 27 | TTGGTGACTCATGAGCGGATT | 2520 | LVTHERI | 3763 | 219.227 |
| 28 | ATGGATAAGTCTAATAATTCT | 2521 | MDKSNNS | 3764 | 216.638 |
| 29 | CGTGGTGATATGTCTCGTGAG | 2522 | RGDMSRE | 3765 | 214.708 |
| 30 | CGCGGTGACGTGGCAGAAATA | 2523 | RGDVAEI | 3766 | 212.967 |
| 31 | GGTGGCGAAAACAGAACCCCA | 2524 | GGENRTP | 3767 | 210.4 |
| 32 | GCTGGGCATCAGCAGCTTGCT | 2525 | AGHQQLA | 3768 | 210.1746 |
| 33 | CGTCTTAATAGTAGTATGAAT | 2526 | RLNSSMN | 3769 | 209.449 |
| 34 | TATTATGAGAAGCTTAGTGCG | 2527 | YYEKLSA | 3770 | 209.263 |
| 35 | GAAGCGTCCAACTACGAACGA | 2528 | EASNYER | 3771 | 209.09 |
| 36 | TTCCAAACTGACACGCACCGA | 2529 | FQTDTHR | 3772 | 208.95 |
| 37 | AACAGTTCCCAATGGCCCAAC | 2530 | NSSQWPN | 3773 | 208.638 |
| 38 | GATGGTAAGACTACGTCTAAT | 2531 | DGKTTSN | 3774 | 207.638 |
| 39 | GCTGTGCATGCGACTAGTAGT | 2532 | AVHATSS | 3775 | 205.952 |
| 40 | AAAACACTCCCCGGCAGGGAA | 2533 | KTLPGRE | 3776 | 205.926 |
| 41 | ATACTGAAATCCGACGCACCA | 2534 | ILKSDAP | 3777 | 204.523 |
| 42 | AGTACGAATGAGGCTCCTAAG | 2535 | STNEAPK | 3778 | 204.522 |
| 43 | TTTGATAGTGCGAATGGTCGG | 2536 | FDSANGR | 3779 | 203.996 |
| 44 | ATGGACGCTGCGTACGGTAGT | 2537 | MDAAYGS | 3780 | 203.401 |
| 45 | AACAAAGACCACAACCACCTG | 2538 | NKDHNHL | 3781 | 202.878 |
| 46 | GGTCAGTATAGTCAGACGCTT | 2539 | GQYSQTL | 3782 | 202.553 |
| 47 | GAAGCATTCCCGCGAGCGGGC | 2540 | EAFPRAG | 3783 | 202.275 |
| 48 | GAACACACTCACTTAAACCCG | 2541 | EHTHLNP | 3784 | 201.959 |
| 49 | ATGCAACGCGAAGACGCGAAC | 2542 | MQREDAN | 3785 | 201.523 |
| 50 | CTAACCGGCTCTGACATGAAA | 2543 | LTGSDMK | 3786 | 200.376 |
| 51 | CGAGTAAACAACGACGCAATA | 2544 | RVNNDAI | 3787 | 200 |
| 52 | CGTGGTGACCAAGGCACACAC | 2545 | RGDQGTH | 3788 | 200 |
| 53 | ATTAATATTAGTAGTGATTTT | 2546 | INISSDF | 3789 | 200 |
| 54 | AATAATGATAATGGTTTTGTT | 2547 | NNDNGFV | 3790 | 200 |
| 55 | TTCATCGCTAACACTAACCCA | 2548 | FIANTNP | 3791 | 200 |
| 56 | GGACTGCACGGCACCAACGCA | 2549 | GLHGTNA | 3792 | 200 |
| 57 | AAAACCATCGACATAGCACAA | 2550 | KTIDIAQ | 3793 | 200 |
| 58 | TCGAGTGATTCTCGTATTCCG | 2551 | SSDSRIP | 3794 | 200 |
| 59 | TCTACATCTCCGGTTAACAGC | 2552 | STSPVNS | 3795 | 200 |

TABLE 2-continued

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 60 | GCCAGCATGCCCTCTGTAGAC | 2553 | ASMPSVD | 3796 | 200 |
| 61 | GGTCATAATATGGCACAGGCG | 2554 | GHNMAQA | 3797 | 200 |
| 62 | CACAACAAACCAAACGGAGAC | 2555 | HNKPNGD | 3798 | 197.851 |
| 63 | TACAGGATGGAAACGAACCCA | 2556 | YRMETNP | 3799 | 197.46 |
| 64 | CTTGGGAATGTGGTTCATCCG | 2557 | LGNVVHP | 3800 | 197.383 |
| 65 | GTAACGGCACACCAATTATCC | 2558 | VTAHQLS | 3801 | 196.095 |
| 66 | ACTATGGTAGAAGTACTGCCA | 2559 | TMVEVLP | 3802 | 195.586 |
| 67 | ATCAAAGGGTCTGGGTCGCAA | 2560 | IKGSGSQ | 3803 | 195.296 |
| 68 | ACTAATGGGGGGTCGCTTAAT | 2561 | TNGGSLN | 3804 | 193.959 |
| 69 | CTCGGAGGAAACAGCAGGATC | 2562 | LGGNSRI | 3805 | 193.21 |
| 70 | AGGGGTGATGCGGCGAATAAG | 2563 | RGDAANK | 3806 | 193.16 |
| 71 | GCGTTAAACGCCCAAGGGATC | 2564 | ALNAQGI | 3807 | 192.986 |
| 72 | GCTGAGCATGCGACTAGTAGT | 2565 | AEHATSS | 3808 | 192.59 |
| 73 | TACTTGACCACCGGTACTGCC | 2566 | YLTTGTA | 3809 | 191.521 |
| 74 | GCGGAGGCTCAGACGCGTGTG | 2567 | AEAQTRV | 3810 | 189.899 |
| 75 | GCTGAGCAGGGGCTGTCTTCG | 2568 | AEQGLSS | 3811 | 188.94 |
| 76 | CTGATTGTTACTCAGCATGTG | 2569 | LIVTQHV | 3812 | 188.588 |
| 77 | TCTAGTTATCAGTCTGGGCTG | 2570 | SSYQSGL | 3813 | 188.4 |
| 78 | GCTACGGTTTATAATGAGTTG | 2571 | ATVYNEL | 3814 | 188.18 |
| 79 | CATGATACGGTTGGGGAGAGG | 2572 | HDTVGER | 3815 | 187.269 |
| 80 | CGTGGGGATTTGAATGATTCT | 2573 | RGDLNDS | 3816 | 187.25 |
| 81 | CATGATATTAGTCTGGATCGT | 2574 | HDISLDR | 3817 | 186.65 |
| 82 | ACAGAACAATCTTACTCACGA | 2575 | TEQSYSR | 3818 | 186.237 |
| 83 | TGGTGAGGGGCTGAGTTTGCC | 2576 | W*GAEFA | 3819 | 186.1 |
| 84 | GCTGTGCATGCGACTAGTAGA | 2577 | AVHATSR | 3820 | 185.9 |
| 85 | ATTGAGAGTAAGACTGTGCAG | 2578 | IESKTVQ | 3821 | 185.818 |
| 86 | ACGAATGTTAGTACGCTTTTG | 2579 | TNVSTLL | 3822 | 184.365 |
| 87 | CCACCCAACGGCAGCAGTAGA | 2580 | PPNGSSR | 3823 | 183.258 |
| 88 | CCCTCTACACACGGCTACGTA | 2581 | PSTHGYV | 3824 | 183.235 |
| 89 | ACTGCGGCTAGTACTGCGAGG | 2582 | TAASTAR | 3825 | 182.452 |
| 90 | TACAACGCAGGCGGAGAACAA | 2583 | YNAGGEQ | 3826 | 182.14 |
| 91 | ACCCACAACCAACGTGAACTG | 2584 | THNQREL | 3827 | 181.989 |
| 92 | ACCTTCACGGTCGACGGTAGA | 2585 | TFTVDGR | 3828 | 181.724 |
| 93 | CACTCCAGCCCCGGGTCGTCA | 2586 | HSSPGSS | 3829 | 181.331 |
| 94 | AGTACGAGTGGTTATAATACT | 2587 | STSGYNT | 3830 | 180.372 |
| 95 | TCTGAGAAGCTGACTGATAAG | 2588 | SEKLTDK | 3831 | 180.174 |
| 96 | GGGAGGAACACAAGTAACTTG | 2589 | GRNTSNL | 3832 | 180.156 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 97 | ACCGGAACAGCGATCTCCCGA | 2590 | TGTAISR | 3833 | 180.148 |
| 98 | TCTATGCAGGATCCTTCTTTG | 2591 | SMQDPSL | 3834 | 179.222 |
| 99 | ACTCGGAGTGATATTGGTGTG | 2592 | TRSDIGV | 3835 | 178.75 |
| 100 | ACGCAGAATCATCAGTTGTCT | 2593 | TQNHQLS | 3836 | 178.39 |
| 101 | TTTGTTGATAATAGGCAGCCT | 2594 | FVDNRQP | 3837 | 178.388 |
| 102 | AGTTTGAATTCTTCGAGTACT | 2595 | SLNSSST | 3838 | 177.704 |
| 103 | AAGGCGGTTTCGGAGATTATT | 2596 | KAVSEII | 3839 | 177.335 |
| 104 | GGTACGAGTGATAATTATAGG | 2597 | GTSDNYR | 3840 | 176.93 |
| 105 | ATGTCTAGCCACACCGTCCAA | 2598 | MSSHTVQ | 3841 | 176.741 |
| 106 | AGTATCACCCACAGCAACACC | 2599 | SITHSNT | 3842 | 176.571 |
| 107 | GTTCAGACTAGTACTGGTGCT | 2600 | VQTSTGA | 3843 | 176.399 |
| 108 | CGTGGTGATATGACTCGTGCG | 2601 | RGDMTRA | 3844 | 176.36 |
| 109 | ATTGGTCTGCAGAATTCTACT | 2602 | IGLQNST | 3845 | 176.164 |
| 110 | AGTGCGGATCGTGATAATAAG | 2603 | SADRDNK | 3846 | 173.544 |
| 111 | TACTCTCAATCCATAAAAAAC | 2604 | YSQSIKN | 3847 | 172.725 |
| 112 | CGCTCGTTGGACAGCGGGATG | 2605 | RSLDSGM | 3848 | 172.632 |
| 113 | GCTGTGCCTCAGTCTCTGCCT | 2606 | AVPQSLP | 3849 | 172.274 |
| 114 | GCGAATGATAGTATTAAGCTG | 2607 | ANDSIKL | 3850 | 172.18 |
| 115 | AATGGTAATATTTATCCGTCT | 2608 | NGNIYPS | 3851 | 171.981 |
| 116 | GGGCAAACAAACGCAGTACAC | 2609 | GQTNAVH | 3852 | 171.5364 |
| 117 | CAAGGAGACCTACGTGGCTCG | 2610 | QGDLRGS | 3853 | 171.042 |
| 118 | GTTAAGGCGAGTGCTGGGGTT | 2611 | VKASAGV | 3854 | 170.5608 |
| 119 | ATCGCGTCAACGTGGAACATG | 2612 | IASTWNM | 3855 | 170.52 |
| 120 | AACTCGGCTGAATCCTCGAGA | 2613 | NSAESSR | 3856 | 170.31 |
| 121 | GTCTTCACGGGCCAAACTGAA | 2614 | VFTGQTE | 3857 | 170.216 |
| 122 | TTTGGTACTTCTTATACGACT | 2615 | FGTSYTT | 3858 | 169.719 |
| 123 | GCGGTTAATGAGACTAGGCTT | 2616 | AVNETRL | 3859 | 168.767 |
| 124 | GGTCGGACGGATACTCCTAAT | 2617 | GRTDTPN | 3860 | 168.735 |
| 125 | AACGACCGACCGCTTGCCAGC | 2618 | NDRPLAS | 3861 | 168.71 |
| 126 | GCTTATCAGCTGACTCCGGCT | 2619 | AYQLTPA | 3862 | 168.579 |
| 127 | ATGGGTGAGATGGGTAATATT | 2620 | MGEMGNI | 3863 | 168.24 |
| 128 | GCGGACATGCAACACACCGTA | 2621 | ADMQHTV | 3864 | 168.055 |
| 129 | GCGGTTGTTCTGAATAGTAAT | 2622 | AVVLNSN | 3865 | 168.021 |
| 130 | TTTCGTGATGGTCAGGGTATG | 2623 | FRDGQGM | 3866 | 167.193 |
| 131 | AAATCGACATCAAACATCGAA | 2624 | KSTSNIE | 3867 | 166.8294 |
| 132 | ACCCAAGCCTTCTCCCTAGGC | 2625 | TQAFSLG | 3868 | 166.751 |
| 133 | TGGTCGAGAACTGGAAACACC | 2626 | WSRTGNT | 3869 | 166.483 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 134 | AGCACAAACACCGAACCTAGG | 2627 | STNTEPR | 3870 | 165.304 |
| 135 | GAGAATAGTGATTTGTCTTAT | 2628 | ENSDLSY | 3871 | 165.08 |
| 136 | ATAGACGAACGTTCCTCGATA | 2629 | IDERSSI | 3872 | 165.02 |
| 137 | GATGTGCATTCGAGTATTCCT | 2630 | DVHSSIP | 3873 | 164.85 |
| 138 | ATAAGCGGTTCCACTACACAC | 2631 | ISGSTTH | 3874 | 164.788 |
| 139 | TGGCAAACCCAAGTCACTACA | 2632 | WQTQVTT | 3875 | 164.759 |
| 140 | AACATGGGTCCAATGGGCCGG | 2633 | NMGPMGR | 3876 | 164.41 |
| 141 | GTTACCCAATCGTCCACGCTA | 2634 | VTQSSTL | 3877 | 164.175 |
| 142 | ATTGATCGTAGTGCTAGTTTG | 2635 | IDRSASL | 3878 | 164.016 |
| 143 | TCTCATAGTATTACGGGTCTT | 2636 | SHSITGL | 3879 | 163.92 |
| 144 | AAAGCGGGACAACTAGTGGAA | 2637 | KAGQLVE | 3880 | 163.845 |
| 145 | AGCGGTGTATCAGAAGGAAAC | 2638 | SGVSEGN | 3881 | 163.413 |
| 146 | ACGCTTACATTATCTACCCTC | 2639 | TLTLSTL | 3882 | 163.242 |
| 147 | GCCCACAACAAACACGAAAGT | 2640 | AHNKHES | 3883 | 162.975 |
| 148 | CACAACAACAACCTGCAAAAC | 2641 | HNNNLQN | 3884 | 162.633 |
| 149 | TATAATGAGTCTTCGAATGCG | 2642 | YNESSNA | 3885 | 161.92 |
| 150 | CGTGAGCAGGCTGCGGAGAGG | 2643 | REQAAER | 3886 | 161.523 |
| 151 | ACTCAGTATGGTACTCTGCCG | 2644 | TQYGTLP | 3887 | 161.32 |
| 152 | CATCCTGGGAATAGTTCTGTG | 2645 | HPGNSSV | 3888 | 161.2 |
| 153 | AGTTCTAGGGAGGTGAGTCCG | 2646 | SSREVSP | 3889 | 161.091 |
| 154 | GCAAACTCCACAAGCCAATGG | 2647 | ANSTSQW | 3890 | 160.842 |
| 155 | CGCGACATGATCAACTCATCA | 2648 | RDMINSS | 3891 | 160.83 |
| 156 | GCATTGCCCAGCGGCGCACGA | 2649 | ALPSGAR | 3892 | 160.765 |
| 157 | CCTGGCACCAGTGGATCCCGA | 2650 | PGTSGSR | 3893 | 159.7012 |
| 158 | TGGAACGGAAACGCCACACAA | 2651 | WNGNATQ | 3894 | 158.413 |
| 159 | GGTAAAGCAACCTTAGTCCTC | 2652 | GKATLVL | 3895 | 158.386 |
| 160 | TACACCAACGGGGGCCACCTA | 2653 | YTNGGHL | 3896 | 158.346 |
| 161 | TCACAATACAACGGAACGCAA | 2654 | SQYNGTQ | 3897 | 157.872 |
| 162 | TATTCTAGTGAGAGTGCTTAT | 2655 | YSSESAY | 3898 | 157.56 |
| 163 | GTTAAGGCGGGGGTGGCTGAT | 2656 | VKAGVAD | 3899 | 157.534 |
| 164 | ACGATGGGACGGTGCAGATT | 2657 | TMGTVQI | 3900 | 157.384 |
| 165 | GGTGTGGCTGGTGCGGTGGTG | 2658 | GVAGAVV | 3901 | 156.882 |
| 166 | TATGATAAGACTTTGAGTGTT | 2659 | YDKTLSV | 3902 | 156.791 |
| 167 | CATGGGAGTGCGTATTCGCAG | 2660 | HGSAYSQ | 3903 | 156.45 |
| 168 | ACGGCTAATATTATGAGTAAG | 2661 | TANIMSK | 3904 | 155.935 |
| 169 | TTTTCGCGGGAGACGCTGGCG | 2662 | FSRETLA | 3905 | 155.888 |
| 170 | TTGAGTGGTGCTGGTAGTCAG | 2663 | LSGAGSQ | 3906 | 155.554 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 171 | AGTAATGCGAATCAGATGAGT | 2664 | SNANQMS | 3907 | 155.28 |
| 172 | TCGGTCCTTTCGCCTTCGAAC | 2665 | SVLSPSN | 3908 | 154.987 |
| 173 | GATAATGTGCATGGGCAGGTG | 2666 | DNVHGQV | 3909 | 154.72 |
| 174 | GACGGACGAGAATACGCCTCG | 2667 | DGREYAS | 3910 | 154.33 |
| 175 | ATTTCGAATCAGATTAAGATG | 2668 | ISNQIKM | 3911 | 154.262 |
| 176 | GGTCGAGACAACCAACACGTA | 2669 | GRDNQHV | 3912 | 154.136 |
| 177 | CGTAATCATGAGACTGGGGCT | 2670 | RNHETGA | 3913 | 153.8093 |
| 178 | AGTGGGAGTGGTGCGAATATT | 2671 | SGSGANI | 3914 | 153.55 |
| 179 | TCTATGTCTGATGGGCTTCGG | 2672 | SMSDGLR | 3915 | 153.296 |
| 180 | AAGGAGAGTAGTGCTATGGAG | 2673 | KESSAME | 3916 | 153.04 |
| 181 | GCTAATGCTAGTACTAGTCTG | 2674 | ANASTSL | 3917 | 152.807 |
| 182 | AGTGCTTCTGGTTATTTGGTT | 2675 | SASGYLV | 3918 | 152.79 |
| 183 | GATACTACTCAGAAGCCTCAT | 2676 | DTTQKPH | 3919 | 152.687 |
| 184 | CTAATACGAGGTTCCATGGAA | 2677 | LIRGSME | 3920 | 152.55 |
| 185 | GACCGCACCTACTCAAACACA | 2678 | DRTYSNT | 3921 | 152.447 |
| 186 | GCTCTTGGGCATCAGGGGAAT | 2679 | ALGHQGN | 3922 | 152.38 |
| 187 | GCTAATCATACGTCGCAGGAG | 2680 | ANHTSQE | 3923 | 152.056 |
| 188 | GAGAGGGGTTTGAATACTAAT | 2681 | ERGLNTN | 3924 | 151.4 |
| 189 | ACTGTTGGTGGTAATCATCAT | 2682 | TVGGNHH | 3925 | 151.384 |
| 190 | CCGAGTGATAGGACTACTTAT | 2683 | PSDRTTY | 3926 | 151.365 |
| 191 | TCCAGGCAAGAAAACTTCTCC | 2684 | SRQENFS | 3927 | 151.22 |
| 192 | AATAAGACGACGATGGAGTTT | 2685 | NKTTMEF | 3928 | 151.16 |
| 193 | AAACACACAGAAAACGGGACC | 2686 | KHTENGT | 3929 | 150.985 |
| 194 | GAAACCGGAGCTATGACCTCT | 2687 | ETGAMTS | 3930 | 150.803 |
| 195 | GGTCATAGGGATTCGGGTGGT | 2688 | GHRDSGG | 3931 | 149.991 |
| 196 | AGAAACGCCGAAGGCGGATTG | 2689 | RNAEGGL | 3932 | 149.919 |
| 197 | GGGCAGCGTACGACGAATGAT | 2690 | GQRTTND | 3933 | 149.903 |
| 198 | TATAATGATGCTCTTAGGCCG | 2691 | YNDALRP | 3934 | 149.88 |
| 199 | GGGTATGCGACTACGGTTCAG | 2692 | GYATTVQ | 3935 | 149.694 |
| 200 | ATAGGGGAGGCATAGGAAAC | 2693 | IGGGIGN | 3936 | 149.622 |
| 201 | GTGGCGGTGTCTAATACGCCT | 2694 | VAVSNTP | 3937 | 148.5637 |
| 202 | CTTGCGAATGGTATGACGGCT | 2695 | LANGMTA | 3938 | 148.449 |
| 203 | ATTTCTGGGTCGTCGTCTCTT | 2696 | ISGSSSL | 3939 | 148.328 |
| 204 | TCTAATGTTCATGTTGTTAAT | 2697 | SNVHVVN | 3940 | 148.32 |
| 205 | GTGGAGACTTCGCGTCTGTAT | 2698 | VETSRLY | 3941 | 148.302 |
| 206 | TCGAACGCAGACATCCTCGCC | 2699 | SNADILA | 3942 | 148.08 |
| 207 | AACAACGTAAACCCGTACTCG | 2700 | NNVNPYS | 3943 | 148.016 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 208 | ATAAGTGTAGGTGTGTCCGTA | 2701 | ISVGVSV | 3944 | 147.84 |
| 209 | TCCGCAAACAACATAGCCCCC | 2702 | SANNIAP | 3945 | 147.813 |
| 210 | GGTGTTCAGATGACTGCGGGG | 2703 | GVQMTAG | 3946 | 147.527 |
| 211 | CGTTACATCGCCAACCAAACA | 2704 | RYIANQT | 3947 | 147.305 |
| 212 | ACCACCGAAAGTCTACACCTT | 2705 | TTESLHL | 3948 | 146.899 |
| 213 | GGCTACCAAGACAAAACACGA | 2706 | GYQDKTR | 3949 | 146.705 |
| 214 | GCTTCGCGGCCTGCGGCTCAG | 2707 | ASRPAAQ | 3950 | 146.364 |
| 215 | TCTATTCAGGAGCTGTTGAGG | 2708 | SIQELLR | 3951 | 146.287 |
| 216 | ACTGTGCGTTCGCCTCAGCAG | 2709 | TVRSPQQ | 3952 | 145.74 |
| 217 | GCGGTTCTTGGTGGTAGTAAT | 2710 | AVLGGSN | 3953 | 145.633 |
| 218 | ATGAGTACGGTTCTTCGGGAG | 2711 | MSTVLRE | 3954 | 144.928 |
| 219 | ACTTATGGTATTACTCATGAT | 2712 | TYGITHD | 3955 | 144.751 |
| 220 | GATGCGAATGCGGGTACGAGG | 2713 | DANAGTR | 3956 | 144.597 |
| 221 | TTCAACGGGTACGTCATGGCA | 2714 | FNGYVMA | 3957 | 144.536 |
| 222 | ATTAATAATTTTAATACTCTG | 2715 | INNFNTL | 3958 | 144.08 |
| 223 | GTAGCCAACGAACGCCTACCG | 2716 | VANERLP | 3959 | 143.64 |
| 224 | ACTAATTCTAATCAGGGTTCG | 2717 | TNSNQGS | 3960 | 143.617 |
| 225 | GCGACGCTGAATAATAGTTAT | 2718 | ATLNNSY | 3961 | 143.512 |
| 226 | AAAAACGCTCAAATAGACCTA | 2719 | KNAQIDL | 3962 | 142.66 |
| 227 | CCTGCTACGCTACACCTGACA | 2720 | PATLHLT | 3963 | 142.552 |
| 228 | TTAGGATCGAGCACAGTATCG | 2721 | LGSSTVS | 3964 | 142.325 |
| 229 | AATTGGAATTCTGAGGGTACG | 2722 | NWNSEGT | 3965 | 142.257 |
| 230 | CCAACAAACAACTTAAGTATG | 2723 | PTNNLSM | 3966 | 141.91 |
| 231 | GCGCTTAAGCCGAATTCTACG | 2724 | ALKPNST | 3967 | 141.737 |
| 232 | ATGGTGAATTCGGAGAATACT | 2725 | MVNSENT | 3968 | 141.624 |
| 233 | AGTATGGATGCTCGGTTGACG | 2726 | SMDARLT | 3969 | 141.6 |
| 234 | AATAATGTTGTTAGGGATGAT | 2727 | NNVVRDD | 3970 | 141.597 |
| 235 | ACAAGGGACCAAAGGTCTACA | 2728 | TRDQRST | 3971 | 141.592 |
| 236 | GCTGACATCCGGAACGACAAA | 2729 | ADIRNDK | 3972 | 141.468 |
| 237 | ATGCGGGATAAGATTAATCCG | 2730 | MRDKINP | 3973 | 141.468 |
| 238 | CCGACTCCTAATGAGCATATG | 2731 | PTPNEHM | 3974 | 141.465 |
| 239 | GGATACTCACACAACTCCGAC | 2732 | GYSHNSD | 3975 | 141.448 |
| 240 | CTTCGGGATGGGATTGCTTCT | 2733 | LRDGIAS | 3976 | 141.105 |
| 241 | ATGAACCAAATGGGCGGCCTG | 2734 | MNQMGGL | 3977 | 141.089 |
| 242 | TCTTCGCCTACTAAGGGTACT | 2735 | SSPTKGT | 3978 | 140.803 |
| 243 | TATTTGGATAATCCGTTGACG | 2736 | YLDNPLT | 3979 | 140.516 |
| 244 | GTCATGCAACGATCTGCACAA | 2737 | VMQRSAQ | 3980 | 140.2 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 245 | TCTCTGCAACTCACAGCGGGT | 2738 | SLQLTAG | 3981 | 140.161 |
| 246 | GTGGGGTCTGGGGGTTATAAT | 2739 | VGSGGYN | 3982 | 140.139 |
| 247 | GATCGTCCGAATAATGTGTCG | 2740 | DRPNNVS | 3983 | 140.036 |
| 248 | TTGACTGAGAAGGCTTCTATT | 2741 | LTEKASI | 3984 | 139.945 |
| 249 | ACCACAAAAACGACATCTATG | 2742 | TTKTTSM | 3985 | 139.556 |
| 250 | CGTTTGGACCTGCAAGTCCAC | 2743 | RLDLQVH | 3986 | 139.528 |
| 251 | ACTCATGTGATTGGGGCTGTG | 2744 | THVIGAV | 3987 | 139.34 |
| 252 | ACCCTGACACACCTAAACCCA | 2745 | TLTHLNP | 3988 | 139.142 |
| 253 | ACCTCAATATCGTCGCAAAGC | 2746 | TSISSQS | 3989 | 138.884 |
| 254 | TACCACACCCACCAAGTCGCA | 2747 | YHTHQVA | 3990 | 138.871 |
| 255 | ATGCAAGGGCTTAACAACATG | 2748 | MQGLNNM | 3991 | 138.848 |
| 256 | GGTAGTGCGAGTAATAGTGGT | 2749 | GSASNSG | 3992 | 138.841 |
| 257 | GCGAATACTACGGGGCAGGTG | 2750 | ANTTGQV | 3993 | 138.7122 |
| 258 | AGCGTTGTCAACACCAACATC | 2751 | SVVNTNI | 3994 | 138.699 |
| 259 | TCTAATAATCTGAATCAGGAG | 2752 | SNNLNQE | 3995 | 138.543 |
| 260 | ATGAATGGGAGTGGGATGCAG | 2753 | MNGSGMQ | 3996 | 138.484 |
| 261 | ATAAGTCACGACCTTAAATAC | 2754 | ISHDLKY | 3997 | 138.458 |
| 262 | ACGGTTAATGCGGATGGGTCG | 2755 | TVNADGS | 3998 | 138.21 |
| 263 | AATCATATTAGGAATCCTATG | 2756 | NHIRNPM | 3999 | 138.143 |
| 264 | AGTACGCGGGTTACTCTGGAT | 2757 | STRVTLD | 4000 | 137.85 |
| 265 | GCTATGGGAGCACTCGTGCAC | 2758 | AMGALVH | 4001 | 137.838 |
| 266 | GCGCAAGCCATGTCAAACAGC | 2759 | AQAMSNS | 4002 | 137.76 |
| 267 | AATGCTAATGGTATGAATACT | 2760 | NANGMNT | 4003 | 137.343 |
| 268 | TTGACGCTTCCTAGTGCTAAT | 2761 | LTLPSAN | 4004 | 137.264 |
| 269 | TACCAAACGGGAGACAAAGAC | 2762 | YQTGDKD | 4005 | 137.017 |
| 270 | AGACGGGAAGAAAACGTCAAC | 2763 | RREENVN | 4006 | 136.962 |
| 271 | GGAACTACCACGGCAGTCGCG | 2764 | GTTTAVA | 4007 | 136.8811 |
| 272 | ACGGCTGGTGGGGAGCGTGCG | 2765 | TAGGERA | 4008 | 136.6 |
| 273 | GCCGGTAACGAACCTAGACCC | 2766 | AGNEPRP | 4009 | 136.593 |
| 274 | GCAAACAACACAGCCAACAGT | 2767 | ANNTANS | 4010 | 136.498 |
| 275 | CATGTGAATAGTAGGGATCTT | 2768 | HVNSRDL | 4011 | 136.187 |
| 276 | ACATACCAACTTTCCGGCAAC | 2769 | TYQLSGN | 4012 | 136.059 |
| 277 | CGGGGTGATTCGATGGCTCGG | 2770 | RGDSMAR | 4013 | 135.8517 |
| 278 | TTGAATAATTCTGCGACTGTT | 2771 | LNNSATV | 4014 | 135.76 |
| 279 | CTACACGCTAACAACGAACGG | 2772 | LHANNER | 4015 | 135.723 |
| 280 | ATGGGTTCTACGACTGGTGTG | 2773 | MGSTTGV | 4016 | 135.16 |
| 281 | GTAGTTGCAGGGCACGCAATG | 2774 | VVAGHAM | 4017 | 135.1261 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 282 | GGCAACGAAAAACCATCAGGG | 2775 | GNEKPSG | 4018 | 135.016 |
| 283 | CGTGGTACGGAGGGGACGCCG | 2776 | RGTEGTP | 4019 | 134.8972 |
| 284 | TGGTCCCCCGGACCCGAAGCC | 2777 | WSPGPEA | 4020 | 134.66 |
| 285 | ATTAATGTGAATCAGATGGCG | 2778 | INVNQMA | 4021 | 134.472 |
| 286 | CGGTCGGACGTTATGCAAAGT | 2779 | RSDVMQS | 4022 | 134.362 |
| 287 | AGGGACGTAAGTACAAAAGAA | 2780 | RDVSTKE | 4023 | 134.36 |
| 288 | AAAAAGTCACCCAGACTTGAA | 2781 | KKSPRLE | 4024 | 134.35 |
| 289 | ACGAGCAACACAATGTCAGAC | 2782 | TSNTMSD | 4025 | 134.345 |
| 290 | TCTAAAGGAAACGAACAAATG | 2783 | SKGNEQM | 4026 | 134.224 |
| 291 | GGTTACGCTACGACCGTGCAA | 2784 | GYATTVQ | 4027 | 134.185 |
| 292 | GGATACATGTCTAACGTCATA | 2785 | GYMSNVI | 4028 | 133.922 |
| 293 | GTGACTGTTAGTCTGGATGGG | 2786 | VTVSLDG | 4029 | 133.879 |
| 294 | ACGAATAATTTGCTGGCTCAG | 2787 | TNNLLAQ | 4030 | 133.517 |
| 295 | GCGCAGACGACGGGGTATACG | 2788 | AQTTGYT | 4031 | 133.295 |
| 296 | AGTAAGTCGACTGAGATTATG | 2789 | SKSTEIM | 4032 | 133.249 |
| 297 | TCTGCGATGCACACATTAGTC | 2790 | SAMHTLV | 4033 | 133.226 |
| 298 | GCTGGGGTGCGTGAGTCGTTT | 2791 | AGVRESF | 4034 | 133.15 |
| 299 | CAAGGCAACTCAATGGCGTCC | 2792 | QGNSMAS | 4035 | 132.82 |
| 300 | AAAAACCCGAGTGTCCAAGAA | 2793 | KNPSVQE | 4036 | 132.519 |
| 301 | CCCATAACACGGGAATCGGGA | 2794 | PITRESG | 4037 | 132.424 |
| 302 | AGCCGCTCGGCAGAAATATCG | 2795 | SRSAEIS | 4038 | 131.747 |
| 303 | AACGACATCCCCACACGAGCC | 2796 | NDIPTRA | 4039 | 131.424 |
| 304 | GCATACGGATCGTCCGGAAGA | 2797 | AYGSSGR | 4040 | 131.375 |
| 305 | CTTCATGGGAATTTTAGTCAG | 2798 | LHGNFSQ | 4041 | 131.002 |
| 306 | GCATCCAACGGGCAAGTTAAC | 2799 | ASNGQVN | 4042 | 130.736 |
| 307 | CAGAAGGGGACGGTTACTCTG | 2800 | QKGTVTL | 4043 | 130.375 |
| 308 | AACTCTAGTAACACTGGTTGG | 2801 | NSSNTGW | 4044 | 130.26 |
| 309 | ACGTATCAGCATCAGGGTCCG | 2802 | TYQHQGP | 4045 | 130.231 |
| 310 | GACGGGGTCGCACACCGCTCA | 2803 | DGVAHRS | 4046 | 130.216 |
| 311 | GACGGGCTCACGCTGGAACGC | 2804 | DGLTLER | 4047 | 130.09 |
| 312 | AGGGGTGATCTATCTACGCCT | 2805 | RGDLSTP | 4048 | 130.02 |
| 313 | ATTAATGAGATTGGTAGGATG | 2806 | INEIGRM | 4049 | 129.944 |
| 314 | CCCCAATGGGAACTGACCCG | 2807 | PQWGTDP | 4050 | 129.94 |
| 315 | AAGCAGGTGGCGCATATTGAT | 2808 | KQVAHID | 4051 | 129.831 |
| 316 | AATACTTTGCAGAATAGTCAT | 2809 | NTLQNSH | 4052 | 129.563 |
| 317 | TGGAGCCAAGGGAACACAGCG | 2810 | WSQGNTA | 4053 | 129.438 |
| 318 | AACGAAACGCACGTACCTAAA | 2811 | NETHVPK | 4054 | 129.35 |

TABLE 2-continued

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 319 | GTAACGAACGAATCCCGCGCC | 2812 | VTNESRA | 4055 | 129.059 |
| 320 | CCCGAAGGCCACATGCAAGAC | 2813 | PEGHMQD | 4056 | 129 |
| 321 | TTGGATTCGACTAATTCTAGG | 2814 | LDSTNSR | 4057 | 128.63 |
| 322 | CAGTCGATTGGGCATCCGGTG | 2815 | QSIGHPV | 4058 | 128.17 |
| 323 | GTCCTGGTTAACGTACACAAC | 2816 | VLVNVHN | 4059 | 128.078 |
| 324 | GTGCATAATCCTACTACTACG | 2817 | VHNPTTT | 4060 | 127.727 |
| 325 | GGGGATAAGGCGAGTTTGGCG | 2818 | GDKASLA | 4061 | 127.698 |
| 326 | CTAAACGAATCCCGAGCGTCG | 2819 | LNESRAS | 4062 | 127.597 |
| 327 | GGTTTTCATATTAATGGTGAG | 2820 | GFHINGE | 4063 | 127.526 |
| 328 | AGTGTTAGTTCTGTGGTGTTG | 2821 | SVSSVVL | 4064 | 127.19 |
| 329 | CTTTCGACTACTTCGACGAAG | 2822 | LSTTSTK | 4065 | 127.153 |
| 330 | ACTAATACGCAGAATAATCCG | 2823 | TNTQNNP | 4066 | 127.089 |
| 331 | ACTAATCTTGCTGTTACGCTG | 2824 | TNLAVTL | 4067 | 127.0208 |
| 332 | ATGTCGGATCGTACTTCTGAT | 2825 | MSDRTSD | 4068 | 126.91 |
| 333 | TCCGCGCAATCTTTCGTAGTT | 2826 | SAQSFVV | 4069 | 126.906 |
| 334 | ATGCACACAAGTAGACCCCCA | 2827 | MHTSAPP | 4070 | 126.861 |
| 335 | ATGTCTAGCCACACAGTCCAA | 2828 | MSSHTVQ | 4071 | 126.79 |
| 336 | AGGGATACGGCTAAGGGGGTG | 2829 | RDTAKGV | 4072 | 126.773 |
| 337 | GCGTTAAAATCCGACAGCGCC | 2830 | ALKSDSA | 4073 | 126.73 |
| 338 | CAATACGACGCCAGCCGACAA | 2831 | QYDASRQ | 4074 | 126.66 |
| 339 | TTAGCCGACTCAAACAGCAAA | 2832 | LADSNSK | 4075 | 126.48 |
| 340 | TTTCAGTTGGCTAGTAATCCG | 2833 | FQLASNP | 4076 | 126.372 |
| 341 | AACTCTGTCGTAGGGAACATC | 2834 | NSVVGNI | 4077 | 126.308 |
| 342 | AGGTATGAGAGTACTAGTGCT | 2835 | RYESTSA | 4078 | 126.21 |
| 343 | GCGGATCATAATCATATTGCT | 2836 | ADHNHIA | 4079 | 126.21 |
| 344 | GTAGGCGACCAATCCCGCCCG | 2837 | VGDQSRP | 4080 | 126.106 |
| 345 | TTCAACGAAACTGCCGGGCGA | 2838 | FNETAGR | 4081 | 125.693 |
| 346 | AGCAACTCGTACTTACTCAAC | 2839 | SNSYLLN | 4082 | 125.52 |
| 347 | CGAGGCGACACAAAGAACTAC | 2840 | RGDTKNY | 4083 | 125.09 |
| 348 | ACGACTACTACTATGGCATAC | 2841 | TTTTMAY | 4084 | 125.064 |
| 349 | CGACCCCCGAACGAAAACAGA | 2842 | RPPNENR | 4085 | 124.7157 |
| 350 | TGCGCCAACATGACCAACGGC | 2843 | CANMTNG | 4086 | 124.6 |
| 351 | AATCGGTCGGATAGTTTTGCG | 2844 | NRSDSFA | 4087 | 124.567 |
| 352 | AATCTTTTGACTTCGTCGCCT | 2845 | NLLTSSP | 4088 | 124.54 |
| 353 | AACTCCAGGGAAATGGGTGTA | 2846 | NSREMGV | 4089 | 124.539 |
| 354 | ATGGGGAATCAGAGTGGTGCG | 2847 | MGNQSGA | 4090 | 124.506 |
| 355 | ATGCTCACAGAAACCAAAGCA | 2848 | MLTETKA | 4091 | 124.3 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 356 | CAAAACATCAAAAACATGACA | 2849 | QNIKNMT | 4092 | 124.1 |
| 357 | ATGAGTACGGTTCTTCGCGAG | 2850 | MSTVLRE | 4093 | 124.05 |
| 358 | GACCGTGCCCAAAACAACGAA | 2851 | DRAQNNE | 4094 | 123.95 |
| 359 | CATACGCAGTCGACGGGTTAT | 2852 | HTQSTGY | 4095 | 123.943 |
| 360 | ATGAGTGTGGGGAAGGTTTAT | 2853 | MSVGKVY | 4096 | 123.919 |
| 361 | GCCGGAAACTACCAATCATCA | 2854 | AGNYQSS | 4097 | 123.855 |
| 362 | AGAAACGAAAACGTAAACGCT | 2855 | RNENVNA | 4098 | 123.777 |
| 363 | GACACCCACCACACATCCAGT | 2856 | DTHHTSS | 4099 | 123.766 |
| 364 | ACTAGCTCCCCTGTTCTACAA | 2857 | TSSPVLQ | 4100 | 123.762 |
| 365 | GTGGGCCGTGACGCAGAAGCT | 2858 | VGRDAEA | 4101 | 123.74 |
| 366 | AACATGGAAAGAGGATCGCAA | 2859 | NMERGSQ | 4102 | 123.646 |
| 367 | GACAGACAAACAGGCCAAAAA | 2860 | DRQTGQK | 4103 | 123.6413 |
| 368 | GTCTTCCGGGAAGGCATCGTG | 2861 | VFREGIV | 4104 | 123.54 |
| 369 | TCCGCAAACAACATAGCCACC | 2862 | SANNIAT | 4105 | 123.32 |
| 370 | GTATCAGAAGGACAACGAATC | 2863 | VSEGQRI | 4106 | 123.005 |
| 371 | CACTACGGTAACAAAGACATA | 2864 | HYGNKDI | 4107 | 122.894 |
| 372 | GATGTTTTGCTTAAGAATTTT | 2865 | DVLLKNF | 4108 | 122.89 |
| 373 | CACACGGTTCAAATACGCGAA | 2866 | HTVQIRE | 4109 | 122.8082 |
| 374 | ACATCAGCACTAGCACACCAA | 2867 | TSALAHQ | 4110 | 122.78 |
| 375 | ATCCCAACCGGCCAAACTAGC | 2868 | IPTGQTS | 4111 | 122.752 |
| 376 | CGCAGCGACAAAGGAACGTTG | 2869 | RSDKGTL | 4112 | 122.7439 |
| 377 | AATGGTCTTACGGTTCAGCGG | 2870 | NGLTVQR | 4113 | 122.718 |
| 378 | ACGGTTGAGGGTTCTTATCCG | 2871 | TVEGSYP | 4114 | 122.67 |
| 379 | ACTAGCCACTTAGTACTTGCA | 2872 | TSHLVLA | 4115 | 122.653 |
| 380 | AATCATAGTCTGTCGGAGCAT | 2873 | NHSLSEH | 4116 | 122.5 |
| 381 | TTAACAGGCATGAACAGAGAC | 2874 | LTGMNRD | 4117 | 122.335 |
| 382 | AGTCACAACGCTGGGGTCGCC | 2875 | SHNAGVA | 4118 | 122.285 |
| 383 | GCGCACCAAACCGCCGGGCCA | 2876 | AHQTAGP | 4119 | 122.22 |
| 384 | AATTCTCATGATTTGAAGTAT | 2877 | NSHDLKY | 4120 | 121.99 |
| 385 | ACTACAATGAGTACCGGTCAA | 2878 | TTMSTGQ | 4121 | 121.98 |
| 386 | GGGTTCGGGCACGTGCCCGAA | 2879 | GFGHVPE | 4122 | 121.974 |
| 387 | ATCACCGCCGCGTCACCGCAA | 2880 | ITAASPQ | 4123 | 121.868 |
| 388 | GTTAAGGCGAGTGCTGGGGAT | 2881 | VKASAGD | 4124 | 121.75 |
| 389 | AGTATCACACACAGCAACACC | 2882 | SITHSNT | 4125 | 121.75 |
| 390 | CATAATAATAATATGCTGAAT | 2883 | HNNNMLN | 4126 | 121.659 |
| 391 | CCCAAAACTCTAACTTCGACA | 2884 | PKTLTST | 4127 | 121.479 |
| 392 | ATAACCGGCAACACCGTCGGA | 2885 | ITGNTVG | 4128 | 121.385 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 393 | CTCGGAAACCACTACACACCC | 2886 | LGNHYTP | 4129 | 121.38 |
| 394 | TCGTTTACTAATACGAATCCT | 2887 | SFTNTNP | 4130 | 121.294 |
| 395 | ACGTTGGATCGGAATCAGACT | 2888 | TLDRNQT | 4131 | 121.25 |
| 396 | ATCTCTACGCAAAGACCGCAC | 2889 | ISTQRPH | 4132 | 121.2071 |
| 397 | ACATTCACTACTCTGGGCAAA | 2890 | TFTTLGK | 4133 | 121.179 |
| 398 | GAGAAGCCTTCTCTTGTGATG | 2891 | EKPSLVM | 4134 | 120.927 |
| 399 | CACATCGAAACCAACACTTCG | 2892 | HIETNTS | 4135 | 120.834 |
| 400 | GGTACGAAGGATATTCTGATT | 2893 | GTKDILI | 4136 | 120.792 |
| 401 | GCGACTTTTAGTCATGCTGGT | 2894 | ATFSHAG | 4137 | 120.788 |
| 402 | GCCAACGGCATATTCCAACCG | 2895 | ANGIFQP | 4138 | 120.646 |
| 403 | CTTAATGTGAATACGCTTAAT | 2896 | LNVNTLN | 4139 | 120.55 |
| 404 | ACTTCTGCTAGTGAGAATTGG | 2897 | TSASENW | 4140 | 120.5 |
| 405 | CTTCTTCAGGGTGCGACTAAG | 2898 | LLQGATK | 4141 | 120.358 |
| 406 | GCTCTTGAGACTACTCGTGCT | 2899 | ALETTRA | 4142 | 120.26 |
| 407 | TTAACGGGACAAAACGAATTC | 2900 | LTGQNEF | 4143 | 120.24 |
| 408 | ATTTCTCATGATTTGAAGAAT | 2901 | ISHDLKN | 4144 | 120.191 |
| 409 | GCACAATACAACAACGGCGTA | 2902 | AQYNNGV | 4145 | 120.19 |
| 410 | ACGACGTCTGTGGAGAAGACT | 2903 | TTSVEKT | 4146 | 120.106 |
| 411 | GGTACGTCGGCTATTATGCCT | 2904 | GTSAIMP | 4147 | 120.093 |
| 412 | CAGCTGCAGGGGACTGAGGCG | 2905 | QLQGTEA | 4148 | 120.02 |
| 413 | GCCTTAAAATCCCAAGAACCA | 2906 | ALKSQEP | 4149 | 120.007 |
| 414 | TCTAACAGCAGTGTTGCGGTA | 2907 | SNSSVAV | 4150 | 119.89 |
| 415 | AATCATGGTCGTGCTATTGAT | 2908 | NHGRAID | 4151 | 119.776 |
| 416 | GATACGTATAATAGTAATACT | 2909 | DTYNSNT | 4152 | 119.6 |
| 417 | ACATTCCACCAAGCGGTCAAA | 2910 | TFHQAVK | 4153 | 119.54 |
| 418 | TGGCATACTGGTGTGTTTCAG | 2911 | WHTGVFQ | 4154 | 119.48 |
| 419 | AGGGGTGATCTTTCTACGCCA | 2912 | RGDLSTP | 4155 | 119.47 |
| 420 | ATGCTTAGTCAGGTTCTGACG | 2913 | MLSQVLT | 4156 | 119.414 |
| 421 | GAAAACGAAAACGAGAAAGC | 2914 | ENEKRES | 4157 | 119.391 |
| 422 | ATTTCGAGTTATGATGGTAAT | 2915 | ISSYDGN | 4158 | 119.38 |
| 423 | ACTCGTGGCGACATGGAATTC | 2916 | TRGDMEF | 4159 | 119.36 |
| 424 | AATGTGCAGAATGTGCCTGGG | 2917 | NVQNVPG | 4160 | 119.3363 |
| 425 | TCTTTCACGAACACAAACCCA | 2918 | SFTNTNP | 4161 | 119.24 |
| 426 | TCGAACGCTGGCTACCACTCG | 2919 | SNAGYHS | 4162 | 119.169 |
| 427 | GACTACAAAAACAGCGCGCCA | 2920 | DYKNSAP | 4163 | 119.136 |
| 428 | GTCGGGAAAAACTCGTACGAA | 2921 | VGKNSYE | 4164 | 119.129 |
| 429 | GCTTACGCAGGTGTACTTGGG | 2922 | AYAGVLG | 4165 | 119.123 |

TABLE 2-continued

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 430 | ACGACGTCTGAGCGTGTGAAT | 2923 | TTSERVN | 4166 | 119.105 |
| 431 | GACACCGGAATCAAAAACGTT | 2924 | DTGIKNV | 4167 | 119.05 |
| 432 | TCGACCAGCTCTCTGGTTCCC | 2925 | STSSLVP | 4168 | 119.006 |
| 433 | TGGAGCGCCGGCGAACGGGTG | 2926 | WSAGERV | 4169 | 118.995 |
| 434 | AGTTCGGGGAGTTTGATTACT | 2927 | SSGSLIT | 4170 | 118.945 |
| 435 | TGGATTTCTACTGAGATGAGG | 2928 | WISTEMR | 4171 | 118.93 |
| 436 | TTTGCGGCTGGGGCGCATGGT | 2929 | FAAGAHG | 4172 | 118.92 |
| 437 | ATAGGCGACCGCGACCAACGT | 2930 | IGDRDQR | 4173 | 118.886 |
| 438 | AGTACGATTGGTAATTCTACT | 2931 | STIGNST | 4174 | 118.8619 |
| 439 | GGAAGTGGCACCGTCGGTCGA | 2932 | GSGTVGR | 4175 | 118.714 |
| 440 | CATGTTACGGCGGTGGTTGAT | 2933 | HVTAVVD | 4176 | 118.706 |
| 441 | GATAAGGCGGGGGTGGCTAAT | 2934 | DKAGVAN | 4177 | 118.67 |
| 442 | CGTCTGACTGATACTATGCAT | 2935 | RLTDTMH | 4178 | 118.589 |
| 443 | CTGAACACTCTAATCCACAAA | 2936 | LNTLIHK | 4179 | 118.565 |
| 444 | AGTTATCAGAATCCTCCGCCT | 2937 | SYQNPPP | 4180 | 118.512 |
| 445 | TTGACAGGATTAAACGCTTTC | 2938 | LTGLNAF | 4181 | 118.45 |
| 446 | AGTCCTGTGCTTTCTCCTTCG | 2939 | SPVLSPS | 4182 | 118.377 |
| 447 | GTTCAAACACACATAGGAGTC | 2940 | VQTHIGV | 4183 | 118.36 |
| 448 | CATATGTCTTCTGTTGCGACT | 2941 | HMSSVAT | 4184 | 118.34 |
| 449 | GGAAAAGCCAACGACGGTTCT | 2942 | GKANDGS | 4185 | 118.333 |
| 450 | AGTACTAACGACGAACGCAAA | 2943 | STNDERK | 4186 | 118.28 |
| 451 | CAGGGGGGGAATAGTCGGTTT | 2944 | QGGNSRF | 4187 | 118.236 |
| 452 | CCTAACAACGAAAAAAACCCG | 2945 | PNNEKNP | 4188 | 118.22 |
| 453 | GTGGCTGCGACGGGTGGTACT | 2946 | VAATGGT | 4189 | 118.173 |
| 454 | GCGATTGTGGATAGGGGGAGT | 2947 | AIVDRGS | 4190 | 118.167 |
| 455 | TCCCAACACCACACGCCACTG | 2948 | SQHHTPL | 4191 | 118.137 |
| 456 | TTACAAAGCTCGATGAACGTA | 2949 | LQSSMNV | 4192 | 118.073 |
| 457 | CGAGAAACCAACCCGTCTGAA | 2950 | RETNPSE | 4193 | 117.941 |
| 458 | GGGTTCGGGCACCTGCCCGAA | 2951 | GFGHLPE | 4194 | 117.86 |
| 459 | CGGAATGCTACTGTGACTGTT | 2952 | RNATVTV | 4195 | 117.852 |
| 460 | GTTTCAAACGCTTCGGGCTTA | 2953 | VSNASGL | 4196 | 117.707 |
| 461 | GATCGTCCGAATAATGAGTCG | 2954 | DRPNNES | 4197 | 117.7 |
| 462 | CAGGTTAGTCTGGTGAAGTTG | 2955 | QVSLVKL | 4198 | 117.643 |
| 463 | AGTAATATGCGTGAGGAGATT | 2956 | SNMREEI | 4199 | 117.629 |
| 464 | GATATTGGGCGTTCGAATAGT | 2957 | DIGRSNS | 4200 | 117.45 |
| 465 | GATCATATGAATTTGAGGTCT | 2958 | DHMNLRS | 4201 | 117.365 |
| 466 | ATTGAGCGTAGTAGTGATCGT | 2959 | IERSSDR | 4202 | 117.358 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 467 | TTGTCTCAGAATTTTAATCCT | 2960 | LSQNFNP | 4203 | 117.3026 |
| 468 | TATTCTATGGGTCAGCAGCCG | 2961 | YSMGQQP | 4204 | 117.283 |
| 469 | TACACACAAGGGATAATGAAC | 2962 | YTQGIMN | 4205 | 117.22 |
| 470 | ATGCTGTCTCATGGTGCGCTT | 2963 | MLSHGAL | 4206 | 117.165 |
| 471 | GCTTATAATGCTCGTCTGCCT | 2964 | AYNARLP | 4207 | 116.957 |
| 472 | AGACACTACTCCGACAACGCC | 2965 | RHYSDNA | 4208 | 116.945 |
| 473 | GCACACACAGCCATGACCTAC | 2966 | AHTAMTY | 4209 | 116.935 |
| 474 | CTAACAGGCTCTGACATGAAA | 2967 | LTGSDMK | 4210 | 116.89 |
| 475 | ACCTTACACACGAAAGACTTG | 2968 | TLHTKDL | 4211 | 116.879 |
| 476 | TCGGGTCAAAACGGTACATCA | 2969 | SGQNGTS | 4212 | 116.851 |
| 477 | CGTGGGGACGTCCACACCAAC | 2970 | RGDVHTN | 4213 | 116.829 |
| 478 | ACCGGAACGGCTACACTCCCA | 2971 | TGTATLP | 4214 | 116.72 |
| 479 | CTGGGTACGCTGCTTAGTCAG | 2972 | LGTLLSQ | 4215 | 116.72 |
| 480 | GTCCTCTCCTCCAACCTGTAC | 2973 | VLSSNLY | 4216 | 116.707 |
| 481 | AGTTTGGGGTCGGATCGTATG | 2974 | SLGSDRM | 4217 | 116.61 |
| 482 | AGGGGAGATCTTTCTACGCCT | 2975 | RGDLSTP | 4218 | 116.59 |
| 483 | AGGATGTCGGAGAGTTCTGAT | 2976 | RMSESSD | 4219 | 116.585 |
| 484 | ATGACTGAGAAGGCTTCTATT | 2977 | MTEKASI | 4220 | 116.54 |
| 485 | ACAGAACAATCTTACTAACGA | 2978 | TEQSY*R | 4221 | 116.54 |
| 486 | GTTGAATCTAAATCCGAACCA | 2979 | VESKSEP | 4222 | 116.536 |
| 487 | ATGAATCTTGTGAGGGATTCG | 2980 | MNLVRDS | 4223 | 116.526 |
| 488 | CAAAACCACTCTATAACAACA | 2981 | QNHSITT | 4224 | 116.51 |
| 489 | ACGCTGGACAACAACCACAGC | 2982 | TLDNNHS | 4225 | 116.42 |
| 490 | ACGAAGAGTTTTAATGATCTT | 2983 | TKSFNDL | 4226 | 116.38 |
| 491 | GCCACAGAACACTCAGGGCGC | 2984 | ATEHSGR | 4227 | 116.34 |
| 492 | CAAGGGACTCTCTTGTCTCCA | 2985 | QGTLLSP | 4228 | 116.293 |
| 493 | ACATTCCACCAAGGGGTCAAA | 2986 | TFHQGVK | 4229 | 116.175 |
| 494 | TGTCAGCGGGCTGATTGTGCG | 2987 | CQRADCA | 4230 | 116.17 |
| 495 | CGGTATGATGGTACTCTTAAT | 2988 | RYDGTLN | 4231 | 115.929 |
| 496 | CAAGGCGGTACAAACAACCCC | 2989 | QGGTNNP | 4232 | 115.853 |
| 497 | GGGGGTAACTACCACACCACT | 2990 | GGNYHTT | 4233 | 115.838 |
| 498 | CTGGTTGTTCAGAGTGCGCAG | 2991 | LVVQSAQ | 4234 | 115.7942 |
| 499 | TATCCTCATGAGAGTAAGAAT | 2992 | YPHESKN | 4235 | 115.731 |
| 500 | GAGATTGTTAGGCATACGCAT | 2993 | EIVRHTH | 4236 | 115.724 |
| 501 | GACCGGACAAACAACATGAGC | 2994 | DRTNNMS | 4237 | 115.705 |
| 502 | TCCGTAACCAACGGAGCGGAA | 2995 | SVTNGAE | 4238 | 115.66 |
| 503 | AGCGGACAAAAAAACTCAGAA | 2996 | SGQKNSE | 4239 | 115.653 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 504 | GAGCAGAAGAAGACTGATCAT | 2997 | EQKKTDH | 4240 | 115.565 |
| 505 | AATATTAATGGTGGGGGGAAT | 2998 | NINGGGN | 4241 | 115.563 |
| 506 | AAGCTGCATACTAAGGATCTT | 2999 | KLHTKDL | 4242 | 115.54 |
| 507 | AGCTTCTTGGTAGCCCACCCA | 3000 | SFLVAHP | 4243 | 115.4 |
| 508 | TACCAACAAAACATAGAAATC | 3001 | YQQNIEI | 4244 | 115.388 |
| 509 | AGGGGTGATCTTTCTACGACT | 3002 | RGDLSTT | 4245 | 115.31 |
| 510 | GCGAACCTCAACTTGACCAGT | 3003 | ANLNLTS | 4246 | 115.305 |
| 511 | ACGGTGCAGCATGCGGCGACG | 3004 | TVQHAAT | 4247 | 115.231 |
| 512 | ACCGTAAACCTCCTAGCGGCA | 3005 | TVNLLAA | 4248 | 115.223 |
| 513 | AACCAAAGAGTTGAACAAAAA | 3006 | NQRVEQK | 4249 | 115.222 |
| 514 | AATACTTATACTGCTGCGAAG | 3007 | NTYTAAK | 4250 | 115.189 |
| 515 | ATCCAAAGAGACGTGGGCCAC | 3008 | IQRDVGH | 4251 | 115.098 |
| 516 | ATCTCAGAAATGACTAGGTAC | 3009 | ISEMTRY | 4252 | 115.098 |
| 517 | ATTGCTACTAATGTGATTTAT | 3010 | IATNVIY | 4253 | 115.089 |
| 518 | AACGGCAACCACTCCATAGAC | 3011 | NGNHSID | 4254 | 115.062 |
| 519 | ACGAGTATTGGTAGTGCTAAG | 3012 | TSIGSAK | 4255 | 115.036 |
| 520 | AACGTACACTCTGTTGACAAA | 3013 | NVHSVDK | 4256 | 114.987 |
| 521 | GAACTCTCCGTTCCGAAACCA | 3014 | ELSVPKP | 4257 | 114.93 |
| 522 | TTCCTCGACAAATACAACTAC | 3015 | FLDKYNY | 4258 | 114.888 |
| 523 | TACATCCCGAACAACTCAGGA | 3016 | YIPNNSG | 4259 | 114.881 |
| 524 | GGGCTAGGACAACCCCAACTC | 3017 | GLGQPQL | 4260 | 114.817 |
| 525 | GAGGGGAGTCAGGGGAATCAT | 3018 | EGSQGNH | 4261 | 114.66 |
| 526 | AATATTTATATGGCGAGTGGT | 3019 | NIYMASG | 4262 | 114.66 |
| 527 | AATTTGCAGACTGGTGTTCAG | 3020 | NLQTGVQ | 4263 | 114.65 |
| 528 | ACCGTCGCTCCCTACAGTAGC | 3021 | TVAPYSS | 4264 | 114.65 |
| 529 | TCAAACTACTCTGACGGAATA | 3022 | SNYSDGI | 4265 | 114.649 |
| 530 | GCTACTTACGTTGTCGGAACA | 3023 | ATYVVGT | 4266 | 114.64 |
| 531 | TCAAGGGAAGCGGGTTCAACT | 3024 | SREAGST | 4267 | 114.622 |
| 532 | GCCGGAAAAACCCACGCCGAC | 3025 | AGKTHAD | 4268 | 114.6 |
| 533 | CCGCTTTCTCTTCATAATAGT | 3026 | PLSLHNS | 4269 | 114.589 |
| 534 | CTTCGAGACCTAAACGGAGGA | 3027 | LRDLNGG | 4270 | 114.553 |
| 535 | GATAGGACGTATTCGAATACG | 3028 | DRTYSNT | 4271 | 114.548 |
| 536 | TCGGTCACCAGTGGAACACAA | 3029 | SVTSGTQ | 4272 | 114.541 |
| 537 | AATATGACTTCGGCTTATCAT | 3030 | NMTSAYH | 4273 | 114.52 |
| 538 | GTTATGGGTGGTCCTGGGATT | 3031 | VMGGPGI | 4274 | 114.491 |
| 539 | GCTGGGACTCATACTGATAAG | 3032 | AGTHTDK | 4275 | 114.444 |
| 540 | GGTACTATGAATATTGGTATT | 3033 | GTMNIGI | 4276 | 114.356 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 541 | ACAGCCGGCGGCGAACGCGCC | 3034 | TAGGERA | 4277 | 114.34 |
| 542 | GGTATGACTTCTAATCAGGTT | 3035 | GMTSNQV | 4278 | 114.298 |
| 543 | CATTTTTCGCAGATTACTAAT | 3036 | HFSQITN | 4279 | 114.278 |
| 544 | AGCAGGATAGAAAACAACAAC | 3037 | SRIENNN | 4280 | 114.055 |
| 545 | GATACGGCGAGTTATAATAAT | 3038 | DTASYNN | 4281 | 114 |
| 546 | GTGAATCAGAGTCCTGGGGCT | 3039 | VNQSPGA | 4282 | 113.85 |
| 547 | AATAATATGGGTCATGGTCAT | 3040 | NNMGHGH | 4283 | 113.837 |
| 548 | TCGCGGCTATCACAAGACCCC | 3041 | SRLSQDP | 4284 | 113.832 |
| 549 | TCTACGTCTCAGGCTGTGCAG | 3042 | STSQAVQ | 4285 | 113.802 |
| 550 | CGATGGCAAGGACTGAGCGCG | 3043 | RWQGLSA | 4286 | 113.76 |
| 551 | GCGCATATGCATTCGGAGTTG | 3044 | AHMHSEL | 4287 | 113.74 |
| 552 | AATAATCTTACGAATTCGACG | 3045 | NNLTNST | 4288 | 113.736 |
| 553 | CAGCCTAGTGCGAGTGAGCTT | 3046 | QPSASEL | 4289 | 113.731 |
| 554 | GGGACTTCCTTGGAAAACCGA | 3047 | GTSLENR | 4290 | 113.709 |
| 555 | CTGTCTAATTCGATTACGCCT | 3048 | LSNSITP | 4291 | 113.683 |
| 556 | ACCATAGTGTCCACTTCTTAC | 3049 | TIVSTSY | 4292 | 113.628 |
| 557 | ACCCTAGGCTACCCAGACAAA | 3050 | TLGYPDK | 4293 | 113.563 |
| 558 | TCAAGACACGACGTCCGAAAC | 3051 | SRHDVRN | 4294 | 113.559 |
| 559 | AATGGTAGTGTGGCTAATCCT | 3052 | NGSVANP | 4295 | 113.48 |
| 560 | GCGATGGATGGGTATAGGGTT | 3053 | AMDGYRV | 4296 | 113.462 |
| 561 | TGGACGGGCGCACAACCTTCT | 3054 | WTGAQPS | 4297 | 113.3493 |
| 562 | AAAAACGGCGCCATAGGAACA | 3055 | KNGAIGT | 4298 | 113.335 |
| 563 | GTACTTCCAAGTCGGATCGCG | 3056 | VLPSRIA | 4299 | 113.3 |
| 564 | GATAATGTGAATTCTCAGCCT | 3057 | DNVNSQP | 4300 | 113.207 |
| 565 | GGCGTAAACGCTAGCTACAGC | 3058 | GVNASYS | 4301 | 113.174 |
| 566 | CTGTCTCACGCCATGGACCGG | 3059 | LSHAMDR | 4302 | 113.127 |
| 567 | AGGGCTCATGGGGATAATCAG | 3060 | RAHGDNQ | 4303 | 113.036 |
| 568 | TTGCAGACGCCTGGGACGACG | 3061 | LQTPGTT | 4304 | 113.01 |
| 569 | ACTCAGGTTGTTAGTATTTAT | 3062 | TQVVSIY | 4305 | 113.001 |
| 570 | CAGGTTCAGGGGACTCTGGGG | 3063 | QVQGTLG | 4306 | 112.9928 |
| 571 | GTGGGCAACCAAAACTTACCC | 3064 | VGNQNLP | 4307 | 112.889 |
| 572 | TATGTTGATTATAGTAAGTCG | 3065 | YVDYSKS | 4308 | 112.872 |
| 573 | CTGCTTAATTCTTCGGGTGTG | 3066 | LLNSSGV | 4309 | 112.857 |
| 574 | AATCAGTCGCTTACTATGGAT | 3067 | NQSLTMD | 4310 | 112.793 |
| 575 | GCTGGTAAGGATCTTAGTAAT | 3068 | AGKDLSN | 4311 | 112.792 |
| 576 | TCTTACGTTAGCGTCCCCGCC | 3069 | SYVSVPA | 4312 | 112.668 |
| 577 | AATGAGGGGCGTGTGCAGACT | 3070 | NEGRVQT | 4313 | 112.6219 |

TABLE 2-continued

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 578 | ACTTTGACGCAGACTGGGATG | 3071 | TLTQTGM | 4314 | 112.588 |
| 579 | GGCTTCGCATTAACTGGCACC | 3072 | GFALTGT | 4315 | 112.564 |
| 580 | CAGTCGACGCTGAATAGGCCT | 3073 | QSTLNRP | 4316 | 112.5575 |
| 581 | ACAACAACACACTCCATCTCC | 3074 | TTTHSIS | 4317 | 112.547 |
| 582 | AACACACACAGACAAGAATAC | 3075 | NTHRQEY | 4318 | 112.522 |
| 583 | TCCCAAATAGTCAACACCACA | 3076 | SQIVNTT | 4319 | 112.519 |
| 584 | CTGGTGCTTGAGATGCAGACG | 3077 | LVLEMQT | 4320 | 112.492 |
| 585 | AACGACATCTCCACCCAACGG | 3078 | NDISTQR | 4321 | 112.444 |
| 586 | TACACCGCCGACAAAAAACAA | 3079 | YTADKKQ | 4322 | 112.402 |
| 587 | TTCGGAGCAACCACCACAGCA | 3080 | FGATTTA | 4323 | 112.399 |
| 588 | GTTCAGATTTCTATGAATAAT | 3081 | VQISMNN | 4324 | 112.364 |
| 589 | ATGCATGCGCAGGAGTCTCGT | 3082 | MHAQESR | 4325 | 112.324 |
| 590 | CATGTGAATACTGCTGATCGG | 3083 | HVNTADR | 4326 | 112.313 |
| 591 | TACAGTACAGACTCCACCAAA | 3084 | YSTDSTK | 4327 | 112.271 |
| 592 | GGACACGACCGAACACCAAAC | 3085 | GHDRTPN | 4328 | 112.213 |
| 593 | ACGAGTGGTGTGCTTACGCGG | 3086 | TSGVLTR | 4329 | 112.212 |
| 594 | AATATTGCTATGTCTAAGATT | 3087 | NIAMSKI | 4330 | 112.204 |
| 595 | ATGGGGACTGAGTATCGTATG | 3088 | MGTEYRM | 4331 | 112.185 |
| 596 | CCTTATGCGAATAGGCTTGAG | 3089 | PYANRLE | 4332 | 112.174 |
| 597 | CCGCTTCAGAATAATAAGACG | 3090 | PLQNNKT | 4333 | 112.172 |
| 598 | TCCTTGACGGAAAAAGCGCCG | 3091 | SLTEKAP | 4334 | 112.15 |
| 599 | AATATGGTGTATACGAATGTG | 3092 | NMVYTNV | 4335 | 112.077 |
| 600 | ATGTTAAGTGCCACCCAAGGG | 3093 | MLSATQG | 4336 | 112.047 |
| 601 | AACATGACTCACTCAACCGTA | 3094 | NMTHSTV | 4337 | 112.0108 |
| 602 | ATTTATACGAATAGTCATGTT | 3095 | IYTNSHV | 4338 | 111.93 |
| 603 | TGGTCGCATGATCGGCCTACT | 3096 | WSHDRPT | 4339 | 111.926 |
| 604 | GAAAAAGGCACACCAAGTAGC | 3097 | EKGTPSS | 4340 | 111.922 |
| 605 | CATCATTCTACTGAGTCGTTG | 3098 | HHSTESL | 4341 | 111.911 |
| 606 | CCAAAAAGCACCCAAGTAATG | 3099 | PKSTQVM | 4342 | 111.846 |
| 607 | AGTGATAGGACTGCTCAGCAG | 3100 | SDRTAQQ | 4343 | 111.845 |
| 608 | GCTACCCTCGCACGGACCTCA | 3101 | ATLARTS | 4344 | 111.8417 |
| 609 | ATTTCTCAGGTGTCTTTTAAT | 3102 | ISQVSFN | 4345 | 111.81 |
| 610 | CATTATGGGAATAAGGATATT | 3103 | HYGNKDI | 4346 | 111.805 |
| 611 | AATGATGGGACTGATCGTAGG | 3104 | NDGTDRR | 4347 | 111.574 |
| 612 | ACCAACCACATAACCGGTCCA | 3105 | TNHITGP | 4348 | 111.551 |
| 613 | ACTAATTCTAATCAGAGTTCG | 3106 | TNSNQSS | 4349 | 111.532 |
| 614 | GTGGCGACTCATTATAATGAG | 3107 | VATHYNE | 4350 | 111.52 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 615 | GACCTCGGTACGGCTAGAACC | 3108 | DLGTART | 4351 | 111.516 |
| 616 | GCTCTTAGTCAGAGTGCGGGT | 3109 | ALSQSAG | 4352 | 111.4957 |
| 617 | AAAACCACCCTACACCAAGCA | 3110 | KTTLHQA | 4353 | 111.46 |
| 618 | ATGATAAACGCCATAACTCCA | 3111 | MINAITP | 4354 | 111.432 |
| 619 | GGGTCTACGCCGGGGGCGAGT | 3112 | GSTPGAS | 4355 | 111.327 |
| 620 | AATGAGAAGCCGCAGTCGACG | 3113 | NEKPQST | 4356 | 111.309 |
| 621 | TCATTGATGGGCAGTGCAGGA | 3114 | SLMGSAG | 4357 | 111.287 |
| 622 | ACCGACACGCTCAGCGAAAGA | 3115 | TDTLSER | 4358 | 111.25 |
| 623 | GCCTCGCAATCAGAAAAAAAC | 3116 | ASQSEKN | 4359 | 111.223 |
| 624 | GCTGTTAGAACACCGGCAATG | 3117 | AVRTPAM | 4360 | 111.215 |
| 625 | CCTAATGCTAGTTTTGGTCCG | 3118 | PNASFGP | 4361 | 111.172 |
| 626 | AAAGCCCACGTTGTAGAAATA | 3119 | KAHVVEI | 4362 | 111.166 |
| 627 | TATATTTCGGCGCCTCCGATG | 3120 | YISAPPM | 4363 | 111.15 |
| 628 | CCAATCCAAAACGAATCGTCC | 3121 | PIQNESS | 4364 | 111.128 |
| 629 | GGCGTAACCAACGCTTCCAAA | 3122 | GVTNASK | 4365 | 111.107 |
| 630 | GTAAACGGGGAAAACCAGTC | 3123 | VNGGKPV | 4366 | 111.096 |
| 631 | AGTGTTCTGAGTAGTTCGACT | 3124 | SVLSSST | 4367 | 111.07 |
| 632 | TTAGCACAAGGCACGGACCGG | 3125 | LAQGTDR | 4368 | 111.032 |
| 633 | CAGTCTGTGTCGACTGGGGCG | 3126 | QSVSTGA | 4369 | 110.982 |
| 634 | TTGACGCAGGTTTATCATGAG | 3127 | LTQVYHE | 4370 | 110.91 |
| 635 | AGAGAAATGAGCAGCCTATCT | 3128 | REMSSLS | 4371 | 110.891 |
| 636 | ACGAGTACGATGACTGCGCGT | 3129 | TSTMTAR | 4372 | 110.835 |
| 637 | ACTATTCAGCAGGTTAGTAAT | 3130 | TIQQVSN | 4373 | 110.832 |
| 638 | AGGACGCAAGCAGGGGACTCA | 3131 | RTQAGDS | 4374 | 110.83 |
| 639 | AATACTTATACTGCTGGGAAG | 3132 | NTYTAGK | 4375 | 110.816 |
| 640 | AATGAGCAGAATACGCCGAGT | 3133 | NEQNTPS | 4376 | 110.79 |
| 641 | GGATTCGCCCAACAAGAAGCG | 3134 | GFAQQEA | 4377 | 110.775 |
| 642 | AGTCCGCAGCATGGTGTTATT | 3135 | SPQHGVI | 4378 | 110.7 |
| 643 | GCAGTCCACGCAACATCATCA | 3136 | AVHATSS | 4379 | 110.653 |
| 644 | GGAGACACCCGTGGTGCACAC | 3137 | GDTRGAH | 4380 | 110.63 |
| 645 | GTAAGAGAAACCACACACCTC | 3138 | VRETTHL | 4381 | 110.627 |
| 646 | CTTTCTCAACAACGCGACTAC | 3139 | LSQQRDY | 4382 | 110.6 |
| 647 | GCGACTAGGGGTGAGTCGTCT | 3140 | ATRGESS | 4383 | 110.56 |
| 648 | ACTAATGATTCTGTGGGTAGT | 3141 | TNDSVGS | 4384 | 110.545 |
| 649 | CTTACTAATAATTTTAAGGAT | 3142 | LTNNFKD | 4385 | 110.519 |
| 650 | GTGAATGGGACTCAGATTTTT | 3143 | VNGTQIF | 4386 | 110.47 |
| 651 | GGTAATACTGGGAGTCCGGGG | 3144 | GNTGSPG | 4387 | 110.431 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 652 | TGGACAGCTAACCAAGGCTTA | 3145 | WTANQGL | 4388 | 110.43 |
| 653 | AATACTACTCCGACGAATCAT | 3146 | NTTPTNH | 4389 | 110.42 |
| 654 | GAACGAGTCAACGGGATGGCA | 3147 | ERVNGMA | 4390 | 110.405 |
| 655 | AAAGTCACAAACAACGCATAC | 3148 | KVTNNAY | 4391 | 110.363 |
| 656 | TTATCCTCCGAATCACCCAGG | 3149 | LSSESPR | 4392 | 110.346 |
| 657 | CATACGGCGGCGGTTGCTACT | 3150 | HTAAVAT | 4393 | 110.27 |
| 658 | TACGACAGCCGACTCTACGCG | 3151 | YDSRLYA | 4394 | 110.263 |
| 659 | ATAGAACACATGCTTAGACCC | 3152 | IEHMLRP | 4395 | 110.221 |
| 660 | TACCTAGAATCCAACTACACC | 3153 | YLESNYT | 4396 | 110.18 |
| 661 | GCGTACTCATCTACCGGGCAC | 3154 | AYSSTGH | 4397 | 110.176 |
| 662 | ATCGACATATCGACGCAAAGC | 3155 | IDISTQS | 4398 | 110.14 |
| 663 | ACAACAAACTCAGGCGCGACG | 3156 | TTNSGAT | 4399 | 110.139 |
| 664 | AACGTGCTAACCACGGTTGTC | 3157 | NVLTTVV | 4400 | 110.107 |
| 665 | ACAACCGGAATCGAACGTTCC | 3158 | TTGIERS | 4401 | 110.106 |
| 666 | GCACGAGTGGACACCAACCAA | 3159 | ARVDTNQ | 4402 | 110.09 |
| 667 | CAGAGTGTGAAGGAGGCGATT | 3160 | QSVKEAI | 4403 | 110.069 |
| 668 | GCGTTGCTTAGTGTGAATGAG | 3161 | ALLSVNE | 4404 | 110.013 |
| 669 | GGGCGTGATAATCATCATGCG | 3162 | GRDNHHA | 4405 | 109.959 |
| 670 | ATTCAGTCGCAGTCGCAGTTG | 3163 | IQSQSQL | 4406 | 109.941 |
| 671 | AGTGAGGGTAGTTCGCGGTCG | 3164 | SEGSSRS | 4407 | 109.9403 |
| 672 | GACGTCCAAAACATACGCGAA | 3165 | DVQNIRE | 4408 | 109.921 |
| 673 | AAAGGCCACGCCTACGAAGCC | 3166 | KGHAYEA | 4409 | 109.897 |
| 674 | TATGTTAGGGCGCAGGATCAG | 3167 | YVRAQDQ | 4410 | 109.876 |
| 675 | GTCGACGAATACCGAAGCCGC | 3168 | VDEYRSR | 4411 | 109.853 |
| 676 | ACTCTCTCAGGCTACATGAGA | 3169 | TLSGYMR | 4412 | 109.808 |
| 677 | CCTAGTGTCCGTTTGCCCTTA | 3170 | PSVRLPL | 4413 | 109.742 |
| 678 | AACATAGCAGGCGGAGAACAA | 3171 | NIAGGEQ | 4414 | 109.702 |
| 679 | CTGCTCCAATCGACCTACTTG | 3172 | LLQSTYL | 4415 | 109.672 |
| 680 | CAGTCGGATACGACTTCGATT | 3173 | QSDTTSI | 4416 | 109.605 |
| 681 | ATTAGGTCTGGGAATGCGATG | 3174 | IRSGNAM | 4417 | 109.554 |
| 682 | ATGCTGTCTCAAGTCTTAACA | 3175 | MLSQVLT | 4418 | 109.536 |
| 683 | ACAGAACGCCAAATCGAATTA | 3176 | TERQIEL | 4419 | 109.488 |
| 684 | GGAACCCACGCCTCAGCATAC | 3177 | GTHASAY | 4420 | 109.477 |
| 685 | GTTGAGTCTTCTTATTCTCGG | 3178 | VESSYSR | 4421 | 109.457 |
| 686 | GGTGGGAATTATCATACTAAG | 3179 | GGNYHTK | 4422 | 109.445 |
| 687 | CCCACCAGTCACCAAGAACCC | 3180 | PTSHQEP | 4423 | 109.418 |
| 688 | ACCATAATCGGTGTCTTACCC | 3181 | TIIGVLP | 4424 | 109.381 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 689 | TCTAACAGCGGTTCTACCCTC | 3182 | SNSGSTL | 4425 | 109.379 |
| 690 | TCGATAACGACCGTAGCGAAC | 3183 | SITTVAN | 4426 | 109.347 |
| 691 | GCGTCTCCGGCGCAGACCGGC | 3184 | ASPAQTG | 4427 | 109.331 |
| 692 | TCGTTGCCGAGTCATAGTAAT | 3185 | SLPSHSN | 4428 | 109.3106 |
| 693 | CTACACAACGCCGTCGGACCC | 3186 | LHNAVGP | 4429 | 109.307 |
| 694 | CAAGCCCCGCCAACAGCACAA | 3187 | QAPPTAQ | 4430 | 109.294 |
| 695 | CCTAATACTGCTAGTAATTTT | 3188 | PNTASNF | 4431 | 109.249 |
| 696 | CCCTCCAACAGTGAAAGATTC | 3189 | PSNSERF | 4432 | 109.227 |
| 697 | GAACTCCACGCACAACAACCA | 3190 | ELHAQQP | 4433 | 109.194 |
| 698 | GGTTCTTATTCTGATGGTAGT | 3191 | GSYSDGS | 4434 | 109.162 |
| 699 | TATGGTGTGCAGGCGAATAGT | 3192 | YGVQANS | 4435 | 109.152 |
| 700 | GAAGTAGGTAAAACCACCCAC | 3193 | EVGKTTH | 4436 | 109.116 |
| 701 | ACTTCGCAGGGTAGGAGTCCT | 3194 | TSQGRSP | 4437 | 109.097 |
| 702 | GTAGAACACGTAGCCCACCAA | 3195 | VEHVAHQ | 4438 | 109.092 |
| 703 | ATCCAAAGCAGCTACAACCGC | 3196 | IQSSYNR | 4439 | 109.073 |
| 704 | ACGCTATCGGTTACCCTGGGT | 3197 | TLSVTLG | 4440 | 109.046 |
| 705 | CGGAATGAGCCGGTTAGTACT | 3198 | RNEPVST | 4441 | 108.981 |
| 706 | GTGATTGTGGGGAGTAATGAG | 3199 | VIVGSNE | 4442 | 108.955 |
| 707 | GAGCTGTCTACTCCTATGGTT | 3200 | ELSTPMV | 4443 | 108.948 |
| 708 | GCTTACAACGACCTACGATCA | 3201 | AYNDLRS | 4444 | 108.942 |
| 709 | AACGCGAACTCCGGTGAACGA | 3202 | NANSGER | 4445 | 108.906 |
| 710 | TTGTCATCACAATGGACACAA | 3203 | LSSQWTQ | 4446 | 108.9 |
| 711 | ATCAACGCCGGCAACTACCGA | 3204 | INAGNYR | 4447 | 108.883 |
| 712 | CTGAGGTCGAGTGAGGCTCCG | 3205 | LRSSEAP | 4448 | 108.866 |
| 713 | ACGTCTGATACGAATGCTAGG | 3206 | TSDTNAR | 4449 | 108.858 |
| 714 | CCGAATTCTCCGCATGGTTCT | 3207 | PNSPHGS | 4450 | 108.84 |
| 715 | ACCCAACACCTACCATCCACA | 3208 | TQHLPST | 4451 | 108.803 |
| 716 | GTGCATGGGAATGCTCCGGCT | 3209 | VHGNAPA | 4452 | 108.783 |
| 717 | TCTTCTCAGCGTGATTCTGTT | 3210 | SSQRDSV | 4453 | 108.754 |
| 718 | CCCCCCTCAGTTGACCGAAAA | 3211 | PPSVDRK | 4454 | 108.751 |
| 719 | GAGACTCTGCCGTATAAGAGT | 3212 | ETLPYKS | 4455 | 108.728 |
| 720 | CATCTTAGTCAGGCTAATCAT | 3213 | HLSQANH | 4456 | 108.727 |
| 721 | AAACCGCTAAACGGTACCAAC | 3214 | KPLNGTN | 4457 | 108.683 |
| 722 | TGGCAAACCAACGGCATGCAA | 3215 | WQTNGMQ | 4458 | 108.68 |
| 723 | ACCGTGAACGTCCACTCCGAC | 3216 | TVNVHSD | 4459 | 108.659 |
| 724 | ACCCAATACGTCGTTGCCCCT | 3217 | TQYVVAP | 4460 | 108.64 |
| 725 | AACGTCGACTCCTCTAACGTG | 3218 | NVDSSNV | 4461 | 108.62 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 726 | AACGGATACCAACTACAAATC | 3219 | NGYQLQI | 4462 | 108.573 |
| 727 | GAAGAAACACGGACCAGAATG | 3220 | EETRTRM | 4463 | 108.571 |
| 728 | ACCTCTCCAGCCTCTGACCGG | 3221 | TSPASDR | 4464 | 108.552 |
| 729 | CATAGTGGTGCTGGGGTTCTG | 3222 | HSGAGVL | 4465 | 108.539 |
| 730 | GCTGCTAATCCTAGTACGGAG | 3223 | AANPSTE | 4466 | 108.527 |
| 731 | ATGTTGGTACAAAACACACCC | 3224 | MLVQNTP | 4467 | 108.482 |
| 732 | GTGCAGCAGAATAATATTAAT | 3225 | VQQNNIN | 4468 | 108.473 |
| 733 | CATGATGGTTATGTTCCTAAT | 3226 | HDGYVPN | 4469 | 108.469 |
| 734 | AACTCAGGTAACAACCCCATC | 3227 | NSGNNPI | 4470 | 108.467 |
| 735 | ACGGACAACCCGTCCTACAAA | 3228 | TDNPSYK | 4471 | 108.453 |
| 736 | GGAGGCTTAAGTTTATCCTCG | 3229 | GGLSLSS | 4472 | 108.431 |
| 737 | AATAATGAGAATACGCGTAAT | 3230 | NNENTRN | 4473 | 108.418 |
| 738 | AAGAATAATAATTCTGATTCT | 3231 | KNNNSDS | 4474 | 108.367 |
| 739 | AAGGATGAGCATCTTCATTAT | 3232 | KDEHLHY | 4475 | 108.358 |
| 740 | AATTTTACTATTACGGAGGCG | 3233 | NFTITEA | 4476 | 108.32 |
| 741 | TTGAACCAAAACAGTGTCTCC | 3234 | LNQNSVS | 4477 | 108.304 |
| 742 | AATTCTCATGTTCCTAATAAT | 3235 | NSHVPNN | 4478 | 108.289 |
| 743 | AATTCTACGCATATTAATTCG | 3236 | NSTHINS | 4479 | 108.2563 |
| 744 | CATATGTCTAGTTATTCGTCG | 3237 | HMSSYSS | 4480 | 108.253 |
| 745 | AACGTACCCAACGGACAAGGA | 3238 | NVPNGQG | 4481 | 108.25 |
| 746 | AACGGTCCGACCGGATCCGCC | 3239 | NGPTGSA | 4482 | 108.245 |
| 747 | AAAAGCAACGCGGGATTCGGT | 3240 | KSNAGFG | 4483 | 108.23 |
| 748 | GCGGCCGCACTAGAAACAATA | 3241 | AAALETI | 4484 | 108.223 |
| 749 | AACCGTCAAAGGGACTTCGAA | 3242 | NRQRDFE | 4485 | 108.196 |
| 750 | GGGTCAGGGAACGAACCCGGG | 3243 | GSGNEPG | 4486 | 108.192 |
| 751 | GTTAGTGTGGCTGTGCCTGCG | 3244 | VSVAVPA | 4487 | 108.11 |
| 752 | CACTCTAACACACACTACGAA | 3245 | HSNTHYE | 4488 | 108.11 |
| 753 | CCTGACAGAGCGAACGACAAA | 3246 | PDRANDK | 4489 | 108.058 |
| 754 | CAAGTTGGGGCTCTAATGGTT | 3247 | QVGALMV | 4490 | 108.037 |
| 755 | TTAACACCCCAAGGGACTAGT | 3248 | LTPQGTS | 4491 | 108.028 |
| 756 | CTATACGACGGAAAACACGTC | 3249 | LYDGKHV | 4492 | 107.972 |
| 757 | CTAACCGAATCTGTGAGAAAC | 3250 | LTESVRN | 4493 | 107.93 |
| 758 | AGTACTTATGGGAATACTTAT | 3251 | STYGNTY | 4494 | 107.929 |
| 759 | AATGCTATTTCTACTAATAAT | 3252 | NAISTNN | 4495 | 107.907 |
| 760 | ATTGCTCATGTGTCTACTAAT | 3253 | IAHVSTN | 4496 | 107.849 |
| 761 | AGTGAGGAGAGGACGCGTGCG | 3254 | SEERTRA | 4497 | 107.833 |
| 762 | CGTTGGTCTGAAAACAACTCC | 3255 | RWSENNS | 4498 | 107.83 |

TABLE 2-continued

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 763 | GATGGTAATAATACGACTTAT | 3256 | DGNNTTY | 4499 | 107.748 |
| 764 | GTGACGACTGTTGATAGTGCT | 3257 | VTTVDSA | 4500 | 107.738 |
| 765 | ACCGTAAACAAACAAGTCCG | 3258 | TVKQTSP | 4501 | 107.7213 |
| 766 | TCTATCTACCTCGCGTCCACT | 3259 | SIYLAST | 4502 | 107.712 |
| 767 | ACGACCCGAAACGAACACTCG | 3260 | TTRNEHS | 4503 | 107.707 |
| 768 | TCGTATGATATGCATACGAAT | 3261 | SYDMHTN | 4504 | 107.705 |
| 769 | GTCTCTACATACCTCCTGGCA | 3262 | VSTYLLA | 4505 | 107.687 |
| 770 | GGAGAACAAAGCCACAACCAA | 3263 | GEQSHNQ | 4506 | 107.684 |
| 771 | ACTGCCAACAACCACTCTCCG | 3264 | TANNHSP | 4507 | 107.671 |
| 772 | CAATTCCACGGGACATCTGAA | 3265 | QFHGTSE | 4508 | 107.652 |
| 773 | AACGTTCTGGGAGCGTCTAGC | 3266 | NVLGASS | 4509 | 107.64 |
| 774 | AGGGATAGTACTATTAGTCGG | 3267 | RDSTISR | 4510 | 107.635 |
| 775 | GTTATTGGGACTTCTAGGGAT | 3268 | VIGTSRD | 4511 | 107.5934 |
| 776 | AATTATGAGAAGGAGTTTGTT | 3269 | NYEKEFV | 4512 | 107.592 |
| 777 | ATGGACCAAAGCCACTCCCGA | 3270 | MDQSHSR | 4513 | 107.563 |
| 778 | AATTCTCAGAATCCTCAGGGT | 3271 | NSQNPQG | 4514 | 107.562 |
| 779 | CACACGGGCACGGACAACCGA | 3272 | HTGTDNR | 4515 | 107.5323 |
| 780 | TATAATACTGTTGATCAGCGG | 3273 | YNTVDQR | 4516 | 107.523 |
| 781 | AAAGAAAGCCTCGAAGACGTC | 3274 | KESLEDV | 4517 | 107.49 |
| 782 | ACTGCGAATAGTACGTATGTG | 3275 | TANSTYV | 4518 | 107.479 |
| 783 | TATCTGAATAGTACGCAGATT | 3276 | YLNSTQI | 4519 | 107.436 |
| 784 | CGTGTTGAAGACACCAACTCC | 3277 | RVEDTNS | 4520 | 107.416 |
| 785 | AACGACGCACGCAACCGTGCA | 3278 | NDARNRA | 4521 | 107.37 |
| 786 | AATACTAATAATCAGGAGCAG | 3279 | NTNNQEQ | 4522 | 107.332 |
| 787 | ACCGTCGGATCGAACAGTATA | 3280 | TVGSNSI | 4523 | 107.3 |
| 788 | TATGGGGAGCGTGCTAGGACG | 3281 | YGERART | 4524 | 107.297 |
| 789 | CCGACCGGAGGCTCACCACCA | 3282 | PTGGSPP | 4525 | 107.265 |
| 790 | CTTGGGCAGGTTAATTCTACG | 3283 | LGQVNST | 4526 | 107.229 |
| 791 | GTCTCGGGTCCGGTATCGGTC | 3284 | VSGPVSV | 4527 | 107.222 |
| 792 | GGTACTAATCATGATTTTTCG | 3285 | GTNHDFS | 4528 | 107.169 |
| 793 | AAGACGCTTGATAATAATGCT | 3286 | KTLDNNA | 4529 | 107.165 |
| 794 | CACAGTGAACTACGTCAAAAC | 3287 | HSELRQN | 4530 | 107.157 |
| 795 | GAGAAGAATCTGACTAATGCT | 3288 | EKNLTNA | 4531 | 107.131 |
| 796 | ACCGGACTCGGAGGCAACAGT | 3289 | TGLGGNS | 4532 | 107.113 |
| 797 | AAAGACCACATCCTCAGCCTC | 3290 | KDHILSL | 4533 | 107.108 |
| 798 | ATAACTACTGGCGGAGTGCTA | 3291 | ITTGGVL | 4534 | 107.108 |
| 799 | CTGGCTGATTCGAATTCTAAG | 3292 | LADSNSK | 4535 | 107.1 |

TABLE 2-continued

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 800 | AGTATTTCTGATAAGAATCAG | 3293 | SISDKNQ | 4536 | 107.08 |
| 801 | TATATTGCTGGGGGGGAGCAG | 3294 | YIAGGEQ | 4537 | 107.069 |
| 802 | TTGCCGGATAAGGGGCGGATT | 3295 | LPDKGRI | 4538 | 107.06 |
| 803 | TTGATCCAAACGCAAGGCACG | 3296 | LIQTQGT | 4539 | 107.042 |
| 804 | TACTCCGGAGAACTAAACAAA | 3297 | YSGELNK | 4540 | 107.037 |
| 805 | TGCGCATCAGAAGTTTGCCAA | 3298 | CASEVCQ | 4541 | 107.035 |
| 806 | CTTATGGCTGCTAATACTGCG | 3299 | LMAANTA | 4542 | 107.032 |
| 807 | CATCAGTCTTTTGATGCTGGT | 3300 | HQSFDAG | 4543 | 107.001 |
| 808 | GGGGAGACGCTGAGGTCTCAG | 3301 | GETLRSQ | 4544 | 106.999 |
| 809 | CAGACTGATGGTCCTAATTTT | 3302 | QTDGPNF | 4545 | 106.978 |
| 810 | ACGACGACTAATGTGAATTTT | 3303 | TTTNVNF | 4546 | 106.969 |
| 811 | AACATGACCAACGAAAACGGA | 3304 | NMTNENG | 4547 | 106.938 |
| 812 | GGGTATAGTCCTTCGACGCCG | 3305 | GYSPSTP | 4548 | 106.892 |
| 813 | TTGCAGGTTACGGTTCATAAT | 3306 | LQVTVHN | 4549 | 106.879 |
| 814 | GATCTGACGCATGTTCATCGT | 3307 | DLTHVHR | 4550 | 106.874 |
| 815 | ACGGAGCTTAGTGAGTATACT | 3308 | TELSEYT | 4551 | 106.852 |
| 816 | ATGACAGTCGCCAGTACTAGC | 3309 | MTVASTS | 4552 | 106.843 |
| 817 | AGCAGTCAAGCCCACGGCCCA | 3310 | SSQAHGP | 4553 | 106.822 |
| 818 | ACCAGAAGCCCGAACGAAGAC | 3311 | TRSPNED | 4554 | 106.81 |
| 819 | GATAATAATAAGCATGGTACT | 3312 | DNNKHGT | 4555 | 106.806 |
| 820 | AGGGAGATTGTTCATAGTAAT | 3313 | REIVHSN | 4556 | 106.802 |
| 821 | CGGAAACTTGAACTCGACCTA | 3314 | RKLELDL | 4557 | 106.801 |
| 822 | ATCTACGAAACCGTAACCTTG | 3315 | IYETVTL | 4558 | 106.801 |
| 823 | AATAGTGGTAGTACGAGTTTT | 3316 | NSGSTSF | 4559 | 106.783 |
| 824 | CCAAGTACGAACGAAAGCCGC | 3317 | PSTNESR | 4560 | 106.782 |
| 825 | CAAGCCGACCTCAGGTACAAA | 3318 | QADLRYK | 4561 | 106.773 |
| 826 | GATCAGCCGGGGTATGTGCGT | 3319 | DQPGYVR | 4562 | 106.7387 |
| 827 | GATGCTATGCTTGCTCATCCG | 3320 | DAMLAHP | 4563 | 106.735 |
| 828 | ACACGTCACGACGGCAGTACG | 3321 | TRHDGST | 4564 | 106.675 |
| 829 | CTGGCGAATATGAGTGCGCCG | 3322 | LANMSAP | 4565 | 106.664 |
| 830 | ACTGGTCATCCGCCGGCGGCG | 3323 | TGHPPAA | 4566 | 106.654 |
| 831 | TCGAGTATTAGTCTGCGGTAT | 3324 | SSISLRY | 4567 | 106.645 |
| 832 | ATGCACGTCGACAAAACGAGT | 3325 | MHVDKTS | 4568 | 106.639 |
| 833 | GGGAGTGATTCTAAGCATCCT | 3326 | GSDSKHP | 4569 | 106.5782 |
| 834 | GGAGAAAGCTCCTCAATAAGC | 3327 | GESSSIS | 4570 | 106.551 |
| 835 | GTCGTCCACTCACACAGTGAA | 3328 | VVHSHSE | 4571 | 106.496 |
| 836 | AGTGTGCGGGCGCATGTTTTG | 3329 | SVRAHVL | 4572 | 106.487 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 837 | GCGGATGGGGCTAAGTCTGCT | 3330 | ADGAKSA | 4573 | 106.485 |
| 838 | GGGGAAGCACGCCGAGAAGCC | 3331 | GEARREA | 4574 | 106.442 |
| 839 | TTTAATGCTACGGTGGTGCAT | 3332 | FNATVVH | 4575 | 106.437 |
| 840 | TGGACGGAAGGGGGCTCAGGA | 3333 | WTEGGSG | 4576 | 106.423 |
| 841 | GATTCTTCTTATACGCATCCG | 3334 | DSSYTHP | 4577 | 106.422 |
| 842 | TTCCCAAGTAGGGACAACGTA | 3335 | FPSRDNV | 4578 | 106.39 |
| 843 | GCCATCACGCACATCGGTACA | 3336 | AITHIGT | 4579 | 106.365 |
| 844 | GCTTTTAAGTCGGGTAGTATT | 3337 | AFKSGSI | 4580 | 106.334 |
| 845 | ATGTCAAACGCCTCCTACATA | 3338 | MSNASYI | 4581 | 106.319 |
| 846 | GCGGAGAGGAATGATAGGACG | 3339 | AERNDRT | 4582 | 106.305 |
| 847 | ACATTAGAAACAACCCGCAGC | 3340 | TLETTRS | 4583 | 106.244 |
| 848 | CGCTTACACGGCTCAGACTCG | 3341 | RLHGSDS | 4584 | 106.237 |
| 849 | TATGAGGGGCATATGAATACT | 3342 | YEGHMNT | 4585 | 106.2354 |
| 850 | TCTGTGACGACTAATCTGATG | 3343 | SVTTNLM | 4586 | 106.217 |
| 851 | TTGCGTGATCAGACTAGTATG | 3344 | LRDQTSM | 4587 | 106.167 |
| 852 | CCCGCCAGTCACAGCGCGGGA | 3345 | PASHSAG | 4588 | 106.151 |
| 853 | GTGGTTGAGAATTTGAGGCAG | 3346 | VVENLRQ | 4589 | 106.147 |
| 854 | CAACAATCACAAAACTCTATA | 3347 | QQSQNSI | 4590 | 106.115 |
| 855 | CTTGTTGATACGGATAGGAAT | 3348 | LVDTDRN | 4591 | 106.108 |
| 856 | AACGAAATGGGAAACTACGTC | 3349 | NEMGNYV | 4592 | 106.104 |
| 857 | TCCACCGACCCCCGATACTCA | 3350 | STDPRYS | 4593 | 106.097 |
| 858 | ACTAATGGTATTTATCAGCCT | 3351 | TNGIYQP | 4594 | 106.095 |
| 859 | TGGGTAAACAGTGTGGGCAAC | 3352 | WVNSVGN | 4595 | 106.084 |
| 860 | GGGGTATCTAACAACTCTAGC | 3353 | GVSNNSS | 4596 | 106.079 |
| 861 | AATGTTAATGCGCAGAGTAGG | 3354 | NVNAQSR | 4597 | 106.064 |
| 862 | ACGACGCCGCCTTTTTCTAAT | 3355 | TTPPFSN | 4598 | 106.044 |
| 863 | ACAGGCAGCTCCCACACCAAC | 3356 | TGSSHTN | 4599 | 106.0345 |
| 864 | TACGTCGACAAATCAATGACA | 3357 | YVDKSMT | 4600 | 106.009 |
| 865 | CTAATCAAAAACAACATGCTC | 3358 | LIKNNML | 4601 | 105.9827 |
| 866 | GGGGGTACGGGGTTGTCGAAG | 3359 | GGTGLSK | 4602 | 105.98 |
| 867 | GCTCTTCATAATCTGATGAAT | 3360 | ALHNLMN | 4603 | 105.977 |
| 868 | GTGCATGTGACTAATGTGTTG | 3361 | VHVTNVL | 4604 | 105.924 |
| 869 | TCGACGACGCACCCTTCCGAA | 3362 | STTHPSE | 4605 | 105.898 |
| 870 | AGCGTAGGTAGTCCAACACAC | 3363 | SVGSPTH | 4606 | 105.8936 |
| 871 | ATGAGTAATGATTTGCCTGGG | 3364 | MSNDLPG | 4607 | 105.877 |
| 872 | TTCTCGTCAACCGAAGCCAGA | 3365 | FSSTEAR | 4608 | 105.858 |
| 873 | GCCGGTCACCAACAACTGGCC | 3366 | AGHQQLA | 4609 | 105.846 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 874 | GGTACCATATTACCAAACCAA | 3367 | GTILPNQ | 4610 | 105.829 |
| 875 | AGCGCGGTTTCTGGTAGCAGC | 3368 | SAVSGSS | 4611 | 105.825 |
| 876 | GAGGTGTCTAGGGATGGTCTG | 3369 | EVSRDGL | 4612 | 105.814 |
| 877 | CAATCACTCAAAGACGGCACT | 3370 | QSLKDGT | 4613 | 105.804 |
| 878 | ACGCGTGAGGGTAATCATGCT | 3371 | TREGNHA | 4614 | 105.8 |
| 879 | GTGGCGACCCAAAACCTTCTT | 3372 | VATQNLL | 4615 | 105.795 |
| 880 | GCCGAAATGACGCACCGCCTC | 3373 | AEMTHRL | 4616 | 105.771 |
| 881 | CAACGGCCAGACCCGCTTAAA | 3374 | QRPDPLK | 4617 | 105.764 |
| 882 | GAACACATCTCTAGCTACGGA | 3375 | EHISSYG | 4618 | 105.752 |
| 883 | CAAAAAGCAACGACCAAAAC | 3376 | QKSNDQN | 4619 | 105.744 |
| 884 | AATCTTGTGATGAGTGGGACG | 3377 | NLVMSGT | 4620 | 105.742 |
| 885 | GGAGCGGGACAATCTCACGTG | 3378 | GAGQSHV | 4621 | 105.721 |
| 886 | CTCAACCACACAATGCCCCTC | 3379 | LNHTMPL | 4622 | 105.713 |
| 887 | GTATCACAATCACACGACGTG | 3380 | VSQSHDV | 4623 | 105.687 |
| 888 | GCTAATTCTGCTACTAATCAG | 3381 | ANSATNQ | 4624 | 105.679 |
| 889 | GGCACAGGAGGTAACCGAGAA | 3382 | GTGGNRE | 4625 | 105.671 |
| 890 | GCGAAGTCGTCGATTATTTTG | 3383 | AKSSIIL | 4626 | 105.661 |
| 891 | GGAGGAACAGCCCTTGGGAGC | 3384 | GGTALGS | 4627 | 105.613 |
| 892 | AACAAAGTAGAATCTGACCCA | 3385 | NKVESDP | 4628 | 105.59 |
| 893 | AACTCGAAACAACCCGACGTC | 3386 | NSKQPDV | 4629 | 105.572 |
| 894 | AGTTATGCTGATCGTCGGCTG | 3387 | SYADRRL | 4630 | 105.567 |
| 895 | AATGTGAATCCGAATGGGCCG | 3388 | NVNPNGP | 4631 | 105.53 |
| 896 | GAACACAACTCAAAAACTTAC | 3389 | EHNSKTY | 4632 | 105.496 |
| 897 | ACCCAAGGATCTAACACCACA | 3390 | TQGSNTT | 4633 | 105.489 |
| 898 | AGCAACGTATCAGCTTACGCA | 3391 | SNVSAYA | 4634 | 105.48 |
| 899 | GCGTACAGTGACAGCGCCCGC | 3392 | AYSDSAR | 4635 | 105.457 |
| 900 | GGGTCGCAATACGCGAACCGC | 3393 | GSQYANR | 4636 | 105.402 |
| 901 | ACAATGAGCGTAACTCTGGAA | 3394 | TMSVTLE | 4637 | 105.393 |
| 902 | CAGACGACTATTCTGGCTGCT | 3395 | QTTILAA | 4638 | 105.386 |
| 903 | TTGCTCCAATCCATAGTGGTA | 3396 | LLQSIVV | 4639 | 105.381 |
| 904 | GTTCACGCTAACGCTACATTA | 3397 | VHANATL | 4640 | 105.38 |
| 905 | AACAAAACAAACGCCGACTAC | 3398 | NKTNADY | 4641 | 105.38 |
| 906 | AACTACGACACCGGCGCCAAA | 3399 | NYDTGAK | 4642 | 105.378 |
| 907 | GTCTACCACAACCGCGACGTT | 3400 | VYHNRDV | 4643 | 105.358 |
| 908 | GATTCTGCTCCGAGGTCTATT | 3401 | DSAPRSI | 4644 | 105.351 |
| 909 | TTGATTGCGAATCTGAGTAAT | 3402 | LIANLSN | 4645 | 105.341 |
| 910 | CCGCAAGACGTCCGCCAAACA | 3403 | PQDVRQT | 4646 | 105.331 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 911 | ACAATGACAGCAATAGCAATG | 3404 | TMTAIAM | 4647 | 105.327 |
| 912 | ACATACGCCTCTACTGAAGCG | 3405 | TYASTEA | 4648 | 105.324 |
| 913 | CCTCACGCCAACGGAGTGACA | 3406 | PHANGVT | 4649 | 105.298 |
| 914 | CGGGCTGATGTTTCTTGGTCT | 3407 | RADVSWS | 4650 | 105.286 |
| 915 | CTGACGCACATGACCGGAACC | 3408 | LTHMTGT | 4651 | 105.272 |
| 916 | GCAAACGACTCTGCCAAAACA | 3409 | ANDSAKT | 4652 | 105.269 |
| 917 | GCTAATTCTGGGTTGCATAAT | 3410 | ANSGLHN | 4653 | 105.246 |
| 918 | AACGTGGGCACCGACAGAGAC | 3411 | NVGTDRD | 4654 | 105.231 |
| 919 | GTCGGAACAACCTCGAACGGC | 3412 | VGTTSNG | 4655 | 105.226 |
| 920 | GGAGTTCTTGGGATACTGGTC | 3413 | GVLGILV | 4656 | 105.184 |
| 921 | CGAATCAACGCAGCAATCGAC | 3414 | RINAAID | 4657 | 105.1475 |
| 922 | CCCGACACTCGCCCATCCATA | 3415 | PDTRPSI | 4658 | 105.135 |
| 923 | GGTGAATCACGTACAAACATG | 3416 | GESRTNM | 4659 | 105.119 |
| 924 | ATTTTGCTTGCTCAGTCTGCT | 3417 | ILLAQSA | 4660 | 105.117 |
| 925 | TATAATAGGGATAATGGTTCT | 3418 | YNRDNGS | 4661 | 105.083 |
| 926 | TGGAATAGTCCGGGTGAGGCG | 3419 | WNSPGEA | 4662 | 105.053 |
| 927 | CTGTTGGGGGCTCATCAGCCG | 3420 | LLGAHQP | 4663 | 105.052 |
| 928 | ATTGGTAAGGATAGTGTTCCG | 3421 | IGKDSVP | 4664 | 105.044 |
| 929 | ACGCGGGAGAGTCTGGTGGAT | 3422 | TRESLVD | 4665 | 105.022 |
| 930 | GCCTCTAACCACCTACAAGCC | 3423 | ASNHLQA | 4666 | 105.013 |
| 931 | AATCTTCAGACGGGTAAGGCT | 3424 | NLQTGKA | 4667 | 104.976 |
| 932 | ACTGTAGGATCCTCATACGCT | 3425 | TVGSSYA | 4668 | 104.9737 |
| 933 | GACACTAACGGAATAAAATCA | 3426 | DTNGIKS | 4669 | 104.968 |
| 934 | AGTCTGCGGATGGAGAATAGT | 3427 | SLRMENS | 4670 | 104.957 |
| 935 | ACTAAGGGTAATAATCTGGTT | 3428 | TKGNNLV | 4671 | 104.92 |
| 936 | CATACGAATCAGATGCAGCCT | 3429 | HTNQMQP | 4672 | 104.919 |
| 937 | AACGGCAACTACGACGGCGCG | 3430 | NGNYDGA | 4673 | 104.912 |
| 938 | GAGGCGCATAATCGTGGTAAT | 3431 | EAHNRGN | 4674 | 104.898 |
| 939 | GGGACGGTTAACTCAAGTGCA | 3432 | GTVNSSA | 4675 | 104.861 |
| 940 | GGGCCGACGATGAATCATAAT | 3433 | GPTMNHN | 4676 | 104.854 |
| 941 | GTACCCAACAACAACACTTCG | 3434 | VPNNNTS | 4677 | 104.834 |
| 942 | GTTTCTAACAAATCTGGAAGT | 3435 | VSNKSGS | 4678 | 104.818 |
| 943 | TGGGGAGTCAGTAACTCAGCA | 3436 | WGVSNSA | 4679 | 104.795 |
| 944 | GTCTCTAACGTCCTCTACAGC | 3437 | VSNVLYS | 4680 | 104.772 |
| 945 | GCCGGCCAAAACAGTGTGGGC | 3438 | AGQNSVG | 4681 | 104.77 |
| 946 | GGTACGAGTCTGGAGAATAGG | 3439 | GTSLENR | 4682 | 104.754 |
| 947 | CAGATGAATATTCATGATAAG | 3440 | QMNIHDK | 4683 | 104.736 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 948 | CCTCAACTAAGCGGCACAGCG | 3441 | PQLSGTA | 4684 | 104.733 |
| 949 | AGTTCGACTCCGCAGGATACT | 3442 | SSTPQDT | 4685 | 104.713 |
| 950 | GTGCAGGGGCAGACCGGCTGG | 3443 | VQGQTGW | 4686 | 104.688 |
| 951 | GGTCTGACGGGTGATTTGGTT | 3444 | GLTGDLV | 4687 | 104.682 |
| 952 | AACCACCCCGCACCAAGCTCA | 3445 | NHPAPSS | 4688 | 104.679 |
| 953 | AAAGAAAAAACCACCCGCGAA | 3446 | KEKTTRE | 4689 | 104.665 |
| 954 | ACTACTAATCCGCAGACGCAG | 3447 | TTNPQTQ | 4690 | 104.663 |
| 955 | GGAGGTGAACACGCAAGAAAC | 3448 | GGEHARN | 4691 | 104.66 |
| 956 | ACGACCGAAGCTGTTGTAGCA | 3449 | TTEAVVA | 4692 | 104.656 |
| 957 | CAAAACAGTGACCTCGCCAGC | 3450 | QNSDLAS | 4693 | 104.638 |
| 958 | TACTCTACAGAAGCACGAGTC | 3451 | YSTEARV | 4694 | 104.609 |
| 959 | ACCGGACAAGCGGGCGGATCG | 3452 | TGQAGGS | 4695 | 104.571 |
| 960 | ACTTCGTCTAATCTTTATGTG | 3453 | TSSNLYV | 4696 | 104.559 |
| 961 | ACGGCTCGTGCGATTGATATG | 3454 | TARAIDM | 4697 | 104.551 |
| 962 | CAGGAGTCTAATAGGGGGGTG | 3455 | QESNRGV | 4698 | 104.547 |
| 963 | AGTATCGGATTCTCAGTAGGC | 3456 | SIGFSVG | 4699 | 104.529 |
| 964 | GAGCGGAGTACGCATAATGTT | 3457 | ERSTHNV | 4700 | 104.513 |
| 965 | GCAAACCACGACAACATCGTG | 3458 | ANHDNIV | 4701 | 104.501 |
| 966 | TGGGCTATGAATAATGTGCCG | 3459 | WAMNNVP | 4702 | 104.498 |
| 967 | TATATTGCTGCGGGTGAGCAG | 3460 | YIAAGEQ | 4703 | 104.498 |
| 968 | AGTTCGAATACTTCTGGTAGT | 3461 | SSNTSGS | 4704 | 104.4928 |
| 969 | ATGGGGAAGCATGAGGGTCTT | 3462 | MGKHEGL | 4705 | 104.481 |
| 970 | GTGCTTACTCATCTGCCGACG | 3463 | VLTHLPT | 4706 | 104.4786 |
| 971 | GAAATGGGTAACCAATACCCA | 3464 | EMGNQYP | 4707 | 104.453 |
| 972 | AGTCTGCGTCCAACCCTACCT | 3465 | SLAPTLP | 4708 | 104.448 |
| 973 | TCGGCTAACTTATACAAACAA | 3466 | SANLYKQ | 4709 | 104.394 |
| 974 | CAAAACGACAGAAAACCGGAC | 3467 | QNDRKPD | 4710 | 104.391 |
| 975 | ATTATTTCGGGTATTACGGTG | 3468 | IISGITV | 4711 | 104.365 |
| 976 | CCATCCGAAATGAGGGCCGTA | 3469 | PSEMRAV | 4712 | 104.361 |
| 977 | TTGGTTACGCAGACGCCGAAT | 3470 | LVTQTPN | 4713 | 104.337 |
| 978 | ATTGCGCAGAATGAGACGTAT | 3471 | IAQNETY | 4714 | 104.336 |
| 979 | CCATACTTAAGAAACATGGCG | 3472 | PYLRNMA | 4715 | 104.321 |
| 980 | GGCGTGAACACAAAAATCGAA | 3473 | GVNTKIE | 4716 | 104.311 |
| 981 | TACTCTTCTGAAATGAGCGAA | 3474 | YSSEMSE | 4717 | 104.31 |
| 982 | TTAGAAACCCAACACCAGCA | 3475 | LENPTPA | 4718 | 104.305 |
| 983 | GGTGTTATGTCTAATGCTACT | 3476 | GVMSNAT | 4719 | 104.289 |
| 984 | GCCCACACTGCATTAGCGGGG | 3477 | AHTALAG | 4720 | 104.27 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 985 | CCTGTTGTGAGGGATCGTTCT | 3478 | PVVRDRS | 4721 | 104.2336 |
| 986 | TCTGCGGGTATGGTGAGTCTG | 3479 | SAGMVSL | 4722 | 104.229 |
| 987 | TCGGGTGTTAATAGTGAGCGT | 3480 | SGVNSER | 4723 | 104.2093 |
| 988 | AATGGGGATGTTACTAATATG | 3481 | NGDVTNM | 4724 | 104.179 |
| 989 | TCTGTTGTGCCTACGGATAAG | 3482 | SVVPTDK | 4725 | 104.174 |
| 990 | AGTAAGGGTGATCAGCTTAAT | 3483 | SKGDQLN | 4726 | 104.166 |
| 991 | GACGGAGAATCCCGATTATCA | 3484 | DGESRLS | 4727 | 104.158 |
| 992 | GGTAATATGAATCATAGTATT | 3485 | GNMNHSI | 4728 | 104.15 |
| 993 | AGTGGGCATGCTTCTCAGGGT | 3486 | SGHASQG | 4729 | 104.148 |
| 994 | GGTTGGAGTAATAATGAGTTG | 3487 | GWSNNEL | 4730 | 104.145 |
| 995 | GGTGTGCATACTCATACTGTT | 3488 | GVHTHTV | 4731 | 104.139 |
| 996 | CACGTGACAGTAACGTTAAAC | 3489 | HVTVTLN | 4732 | 104.124 |
| 997 | ACCCGTGGCAACGACATATCA | 3490 | TRGNDIS | 4733 | 104.058 |
| 998 | AGCAAAGGCGGCGACATGGTT | 3491 | SKGGDMV | 4734 | 104.043 |
| 999 | ACGCATGGTGATCATATTCAG | 3492 | THGDHIQ | 4735 | 104.032 |
| 1000 | ACTACGAATTCTCATGCGATT | 3493 | TTNSHAI | 4736 | 104.021 |
| 1001 | GTCAGAACAGTCCTTCAACAA | 3494 | VRTVLQQ | 4737 | 104.017 |
| 1002 | ACTGTGCGTTCGCCTCAGCCG | 3495 | TVRSPQP | 4738 | 104.015 |
| 1003 | AATACTTATACTGCTGGTAAG | 3496 | NTYTAGK | 4739 | 104.005 |
| 1004 | ATTAGTAATCCGGAGAATACG | 3497 | ISNPENT | 4740 | 103.998 |
| 1005 | ATCGGGTCGCCGTTGGCCAAC | 3498 | IGSPLAN | 4741 | 103.928 |
| 1006 | TATACGGGTACTCTTGTTGTT | 3499 | YTGTLVV | 4742 | 103.911 |
| 1007 | GGGCGGCACACATTAGCGGAC | 3500 | GRHTLAD | 4743 | 103.908 |
| 1008 | ACTGATGGGCCGCGTCTGGCT | 3501 | TDGPRLA | 4744 | 103.881 |
| 1009 | GGGGCAGGAAACCTGGGTACC | 3502 | GAGNLGT | 4745 | 103.873 |
| 1010 | CTGATGAATCGTAATGCTCCT | 3503 | LMNRNAP | 4746 | 103.8648 |
| 1011 | AATGCTATGGCTTCTAGTAGG | 3504 | NAMASSR | 4747 | 103.826 |
| 1012 | CAGCATCGTGCGCAGGATGTG | 3505 | QHRAQDV | 4748 | 103.8248 |
| 1013 | AAAATAGAAAGCGGAACCATA | 3506 | KIESGTI | 4749 | 103.822 |
| 1014 | ACTAATTATCCTGAGGCGAAT | 3507 | TNYPEAN | 4750 | 103.806 |
| 1015 | GTATACCACGGGGTAGCCAGC | 3508 | VYHGVAS | 4751 | 103.803 |
| 1016 | TCCAACGTCCACGTAGTAAAC | 3509 | SNVHVVN | 4752 | 103.791 |
| 1017 | ACATACACCGACGGGAACCCC | 3510 | TYTDGNP | 4753 | 103.788 |
| 1018 | TTTATTGCGAATACGAATCCT | 3511 | FIANTNP | 4754 | 103.787 |
| 1019 | GACGCCGGGTACGGCCACGAC | 3512 | DAGYGHD | 4755 | 103.785 |
| 1020 | GGTCTTAGTCGGAATGATGGT | 3513 | GLSRNDG | 4756 | 103.783 |
| 1021 | ATGATGGGCGCGACAACGAAA | 3514 | MMGATTK | 4757 | 103.779 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1022 | CCCATCAACGTACTCACGACA | 3515 | PINVLTT | 4758 | 103.771 |
| 1023 | GCCGTAGACCAATCACGTTTG | 3516 | AVDQSRL | 4759 | 103.765 |
| 1024 | AACGCTTCTACCTACATGGAC | 3517 | NASTYMD | 4760 | 103.728 |
| 1025 | ACACAAGCAGGTCTTGCGTCA | 3518 | TQAGLAS | 4761 | 103.696 |
| 1026 | GCACAATTCGAATCAGGCCGA | 3519 | AQFESGR | 4762 | 103.693 |
| 1027 | CGGAATGGTGGTACTACGGAT | 3520 | RNGGTTD | 4763 | 103.669 |
| 1028 | GCTAATACGTATAATGTTCAG | 3521 | ANTYNVQ | 4764 | 103.64 |
| 1029 | TCGGGTGTTCATAGTGAGCGT | 3522 | SGVHSER | 4765 | 103.636 |
| 1030 | AACACCGGCACCACGAGTGTC | 3523 | NTGTTSV | 4766 | 103.635 |
| 1031 | AGTACGAGTAATAGTCATATG | 3524 | STSNSHM | 4767 | 103.632 |
| 1032 | GGTGAACAACACAACGCCCCC | 3525 | GEQHNAP | 4768 | 103.629 |
| 1033 | GCTCATCATATGACGACGGAG | 3526 | AHHMTTE | 4769 | 103.614 |
| 1034 | TTGATGACTGGTACTGCGTCG | 3527 | LMTGTAS | 4770 | 103.575 |
| 1035 | GCTGCCGGAGCCGACTCTCCA | 3528 | AAGADSP | 4771 | 103.568 |
| 1036 | GTGTCTCTGAGTTCGCCTCCG | 3529 | VSLSSPP | 4772 | 103.563 |
| 1037 | CGTGTTGTAGCCGGTCCCAAC | 3530 | RVVAGPN | 4773 | 103.534 |
| 1038 | GATAAGACTGAGATGCTGCAG | 3531 | DKTEMLQ | 4774 | 103.525 |
| 1039 | GCACGAGACGACACGATACAA | 3532 | ARDDTIQ | 4775 | 103.523 |
| 1040 | TTACACCTTGGGTTATCATCT | 3533 | LHLGLSS | 4776 | 103.513 |
| 1041 | CTCGAAGGACAACGGGACGTC | 3534 | LEGQRDV | 4777 | 103.505 |
| 1042 | GCGTCGTTGTCGGCTCCGGCG | 3535 | ASLSAPA | 4778 | 103.5036 |
| 1043 | AGCAACCCTGGGAACCACAAC | 3536 | SNPGNHN | 4779 | 103.502 |
| 1044 | GGGCTGAATTCTAAGGGGACT | 3537 | GLNSKGT | 4780 | 103.471 |
| 1045 | AAAACACCCTCAGCTTCAGAA | 3538 | KTPSASE | 4781 | 103.47 |
| 1046 | GTGCTGGCGTCGACTGAGAAG | 3539 | VLASTEK | 4782 | 103.451 |
| 1047 | TCGGTATTGAACAAACCAACA | 3540 | SVLNKPT | 4783 | 103.441 |
| 1048 | CCCGGTAACGGACAAAGTCCG | 3541 | PGNGQSP | 4784 | 103.396 |
| 1049 | ATCTTGATGGGCGCTAGGACA | 3542 | ILMGART | 4785 | 103.385 |
| 1050 | GCACTACCATCCCACTCCTCC | 3543 | ALPSHSS | 4786 | 103.382 |
| 1051 | AGGGATCAGACTCATCCGAAT | 3544 | RDQTHPN | 4787 | 103.378 |
| 1052 | TCTGGTCCGATTCCTGCTGTT | 3545 | SGPIPAV | 4788 | 103.376 |
| 1053 | TACGTGGACGACAACAGTCGC | 3546 | YVDDNSR | 4789 | 103.35 |
| 1054 | TTGACTCGGGGGGTCGCCGCA | 3547 | LTRGVAA | 4790 | 103.334 |
| 1055 | TCTGAGAAGGAGGCTCGGCTG | 3548 | SEKEARL | 4791 | 103.326 |
| 1056 | TCCACAACGCCTCCCTTCAAA | 3549 | STTPPFK | 4792 | 103.308 |
| 1057 | TACTCGACAACCATGCTTAAC | 3550 | YSTTMLN | 4793 | 103.299 |
| 1058 | AAAAACGGTGTTATAAACGAC | 3551 | KNGVIND | 4794 | 103.292 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1059 | TTCGGTATAGGGCACGGAACA | 3552 | FGIGHGT | 4795 | 103.278 |
| 1060 | CCTCTTCATGTTGCTTCTCCT | 3553 | PLHVASP | 4796 | 103.245 |
| 1061 | TTGGGTAATGGTAGTTCTTTG | 3554 | LGNGSSL | 4797 | 103.239 |
| 1062 | AGTGGCAACGCGAACATAGTA | 3555 | SGNANIV | 4798 | 103.225 |
| 1063 | GGGATTAATCGTACTAGTGAG | 3556 | GINRTSE | 4799 | 103.19 |
| 1064 | TCGGATAATAGGAATACTGCG | 3557 | SDNRNTA | 4800 | 103.19 |
| 1065 | CGATTAGGAACCGTCACCAAC | 3558 | RLGTVTN | 4801 | 103.189 |
| 1066 | GTGGAGCATGTTGCTCATCAG | 3559 | VEHVAHQ | 4802 | 103.185 |
| 1067 | TATACTAAGCATCCTGTTGAG | 3560 | YTKHPVE | 4803 | 103.172 |
| 1068 | TCCCGAATCACGGTGAACGCA | 3561 | SRITVNA | 4804 | 103.154 |
| 1069 | ACAGTATCGTCATACGTACAA | 3562 | TVSSYVQ | 4805 | 103.134 |
| 1070 | CGCGCCGAAGGGAGCTCTGGC | 3563 | RAEGSSG | 4806 | 103.127 |
| 1071 | GCTGTGGGCGGTCGGATGAT | 3564 | AVGRSDD | 4807 | 103.119 |
| 1072 | CGCATAGGCGTTGGAGCACCA | 3565 | RIGVGAP | 4808 | 103.113 |
| 1073 | TACTCAAACCTCGTACTTTCC | 3566 | YSNLVLS | 4809 | 103.095 |
| 1074 | TCGACGAATTCTGAGGCGGTT | 3567 | STNSEAV | 4810 | 103.068 |
| 1075 | GCAATGTCAACCCACATGATA | 3568 | AMSTHMI | 4811 | 103.067 |
| 1076 | AGGGTTGATATTTCGCATTTT | 3569 | RVDISHF | 4812 | 103.049 |
| 1077 | ATTCTTACGCCTTTGGATAAG | 3570 | ILTPLDK | 4813 | 103.039 |
| 1078 | GTTGCGAGTACGACGCAGACT | 3571 | VASTTQT | 4814 | 103.033 |
| 1079 | GACCGTAGCTCCGCGACGCTC | 3572 | DRSSATL | 4815 | 103.014 |
| 1080 | GATCATAGTGAGCAGAATTCG | 3573 | DHSEQNS | 4816 | 102.995 |
| 1081 | ATACGCAGCGAATTGGAAGTA | 3574 | IRSELEV | 4817 | 102.969 |
| 1082 | GCGAATCTGGGTGATGTTGAG | 3575 | ANLGDVE | 4818 | 102.969 |
| 1083 | GAGCTTAAGGAGAGTCAGAAG | 3576 | ELKESQK | 4819 | 102.956 |
| 1084 | TCATACACAGCAGGAAGACCC | 3577 | SYTAGRP | 4820 | 102.953 |
| 1085 | GGACCAGCCTACAACCAAAGC | 3578 | GPAYNQS | 4821 | 102.924 |
| 1086 | CATGAGAGTCATTATGTTAGT | 3579 | HESHYVS | 4822 | 102.921 |
| 1087 | AATGGTAAGCTGGGTACGACT | 3580 | NGKLGTT | 4823 | 102.921 |
| 1088 | CTTCCGCCTGCGTCGGCGGGT | 3581 | LPPASAG | 4824 | 102.917 |
| 1089 | TTGTCGTATCAGACTGGTCAT | 3582 | LSYQTGH | 4825 | 102.916 |
| 1090 | GACAGCCAAATCACAAGACTA | 3583 | DSQITRL | 4826 | 102.909 |
| 1091 | AACGTATACGAAGGGCACCGC | 3584 | NVYEGHR | 4827 | 102.909 |
| 1092 | TTGTTTACTGCTGGGAGTACT | 3585 | LFTAGST | 4828 | 102.863 |
| 1093 | CTTGTGAATAATGATGGGACT | 3586 | LVNNDGT | 4829 | 102.861 |
| 1094 | GCGATGAATGTGCGGAGTGAT | 3587 | AMNVRSD | 4830 | 102.858 |
| 1095 | GCCAGCCTTGACCGCCTTCCA | 3588 | ASLDRLP | 4831 | 102.857 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1096 | GGCTCTCGGAACGGACCCACA | 3589 | GSRNGPT | 4832 | 102.8532 |
| 1097 | ATGAGTGATGGGCATTCGAAG | 3590 | MSDGHSK | 4833 | 102.833 |
| 1098 | TCTAACCGTACGGAAATGCCA | 3591 | SNRTEMF | 4834 | 102.815 |
| 1099 | AACGTGGTGAAAAACAACACA | 3592 | NVVKNNT | 4835 | 102.801 |
| 1100 | GTGGTCGACTCAACATACCCG | 3593 | VVDSTYP | 4836 | 102.793 |
| 1101 | GTGGCTGGGGGGACTTCGGAG | 3594 | VAGGTSE | 4837 | 102.789 |
| 1102 | CGGGCAGACATGACTCCCTTA | 3595 | RADMTPL | 4838 | 102.77 |
| 1103 | GGACACGAACAAACTGACGCA | 3596 | GHEQTDA | 4839 | 102.764 |
| 1104 | AGTGCTTTGATTAGTGTGGTT | 3597 | SALISVV | 4840 | 102.756 |
| 1105 | AACTCGACAACGGCACAATCA | 3598 | NSTTAQS | 4841 | 102.75 |
| 1106 | TACGGCGACCTAACTACAGTC | 3599 | YGDLTTV | 4842 | 102.737 |
| 1107 | GCACGCAACGACGGACAAGGA | 3600 | ARNDGQG | 4843 | 102.734 |
| 1108 | CTGAACGTTAGTTCATCCAAA | 3601 | LNVSSSK | 4844 | 102.693 |
| 1109 | TCTGGCGTCTCGAAAGAACGG | 3602 | SGVSKER | 4845 | 102.692 |
| 1110 | AACATGGAACACACCATGGCG | 3603 | NMEHTMA | 4846 | 102.687 |
| 1111 | GCTCGTCCGGCTTCGTCTGAT | 3604 | ARPASSD | 4847 | 102.6705 |
| 1112 | CTTAGGGAAGAATCTGCACGT | 3605 | LREESAR | 4848 | 102.639 |
| 1113 | TTGGCCAACATGTCCGCACCA | 3606 | LANMSAP | 4849 | 102.61 |
| 1114 | AACCACACGGTAGAAGGACGC | 3607 | NHTVEGR | 4850 | 102.598 |
| 1115 | CCTCAGCATCAGCATGAGCAT | 3608 | PQHQHEH | 4851 | 102.582 |
| 1116 | AATTCTTCGGAGCTGAAGACG | 3609 | NSSELKT | 4852 | 102.564 |
| 1117 | CTTGTTGCTGAGCGTTTGCCG | 3610 | LVAERLP | 4853 | 102.552 |
| 1118 | AACGTTATGCACTCTTCCTCC | 3611 | NVMHSSS | 4854 | 102.525 |
| 1119 | GCGAGTGATAAGGGGCGAAT | 3612 | ASDKGAN | 4855 | 102.509 |
| 1120 | AGTCTGGATCGGAAGCCTCCG | 3613 | SLDRKPP | 4856 | 102.5032 |
| 1121 | ACAGAACACGAAAAATCCACT | 3614 | TEHEKST | 4857 | 102.459 |
| 1122 | CCTCATAATCAGGAGATGGGT | 3615 | PHNQEMG | 4858 | 102.449 |
| 1123 | GAGTCTAAGACTGTGGTTATT | 3616 | ESKTVVI | 4859 | 102.442 |
| 1124 | TCGACGGGCCAAAACTTAAAA | 3617 | STGQNLK | 4860 | 102.442 |
| 1125 | GTTCTTCATGTTTCTGATGTT | 3618 | VLHVSDV | 4861 | 102.441 |
| 1126 | CCTGACGCAGCGCGTAGCCCG | 3619 | PDAARSP | 4862 | 102.421 |
| 1127 | GCTCCTCGGCATGCTCATCCT | 3620 | APRHAHP | 4863 | 102.414 |
| 1128 | CATGTGAATCCTACGCCGGCG | 3621 | HVNPTPA | 4864 | 102.401 |
| 1129 | TTGCCTAATGAGCGTCCGGGT | 3622 | LPNERPG | 4865 | 102.397 |
| 1130 | GAGGCTAAGGGTTTTGGTCAT | 3623 | EAKGFGH | 4866 | 102.395 |
| 1131 | TCAGAAAACACCTCTGTACCC | 3624 | SENTSVP | 4867 | 102.388 |
| 1132 | GGTCCCGGAGAAAACTACCGA | 3625 | GPGENYR | 4868 | 102.375 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1133 | TCTCATGAGATGAATAATGGT | 3626 | SHEMNNG | 4869 | 102.366 |
| 1134 | GTAGACACCTACAGCGGTCTG | 3627 | VDTYSGL | 4870 | 102.35 |
| 1135 | GGAGTCCTAGGAAACATGGTA | 3628 | GVLGNMV | 4871 | 102.325 |
| 1136 | GCGCTGGATAATAGTAGTCGG | 3629 | ALDNSSR | 4872 | 102.322 |
| 1137 | TTTCTGGGTTCTAGTAATCAT | 3630 | FLGSSNH | 4873 | 102.321 |
| 1138 | CCTGTGGTTCATGGTGAGCCT | 3631 | PVVHGEP | 4874 | 102.3142 |
| 1139 | CGCAGGGAAGGTATCCTAATG | 3632 | RREGILM | 4875 | 102.305 |
| 1140 | CAGCAGGGGCGCCTACTTCT | 3633 | QQGAPTS | 4876 | 102.303 |
| 1141 | AAGGTTAGTGGTGGGAGACG | 3634 | KVSGGET | 4877 | 102.275 |
| 1142 | GCGAAACACGAAAGCTCGTCT | 3635 | AKHESSS | 4878 | 102.272 |
| 1143 | ATTCTTATGGGTGCGCGTACT | 3636 | ILMGART | 4879 | 102.235 |
| 1144 | ACGCTAGGCAGCAGCAGCACC | 3637 | TLGSSST | 4880 | 102.222 |
| 1145 | CTAAGATCTGAACCGACACAA | 3638 | LRSEPTQ | 4881 | 102.218 |
| 1146 | CGCTCGGAACAAAAAACTCCG | 3639 | RSEQKTP | 4882 | 102.207 |
| 1147 | CACGCTCCAAGCGGCGCCATA | 3640 | HAPSGAI | 4883 | 102.2 |
| 1148 | AGTAGTGTTACTTCGAGGGAG | 3641 | SSVTSRE | 4884 | 102.197 |
| 1149 | GTGAATCCGCATCCTGCGCAG | 3642 | VNPHPAQ | 4885 | 102.185 |
| 1150 | CAATACTCGATGGACACGCGC | 3643 | QYSMDTR | 4886 | 102.173 |
| 1151 | ACTCCTGGTGTTACTAGGACG | 3644 | TPGVTRT | 4887 | 102.172 |
| 1152 | CTTTATGAGGTTGGTACTCCT | 3645 | LYEVGTP | 4888 | 102.165 |
| 1153 | ACGATGACGAGTGAGCTTTCG | 3646 | TMTSELS | 4889 | 102.16 |
| 1154 | TCAGGTTCGGAATACCGTACC | 3647 | SGSEYRT | 4890 | 102.153 |
| 1155 | GAAATGCAAACCAAAAACGCC | 3648 | EMQTKNA | 4891 | 102.144 |
| 1156 | GGCCACGAAAACATGGGCGTG | 3649 | GHENMGV | 4892 | 102.135 |
| 1157 | GGGGCGCATACGTCGGCTTCG | 3650 | GAHTSAS | 4893 | 102.116 |
| 1158 | GCTGATACGCTGCTGCGTAGG | 3651 | ADTLLRR | 4894 | 102.095 |
| 1159 | GACAACAGCAACAACGTCCCA | 3652 | DNSNNVP | 4895 | 102.092 |
| 1160 | ATGACTGCTAACTTGGTGGAA | 3653 | MTANLVE | 4896 | 102.076 |
| 1161 | GAAGCGGGACGCACGCTTCAA | 3654 | EAGRTLQ | 4897 | 102.07 |
| 1162 | AGACACGTCGTCCCCGACTCC | 3655 | RHVVPDS | 4898 | 102.039 |
| 1163 | GTGAGTTCTGAGCAGTATAGG | 3656 | VSSEQYR | 4899 | 102.03 |
| 1164 | GGTATCGAAGCAAGTCGCGGA | 3657 | GIEASRG | 4900 | 102.008 |
| 1165 | AGACAAGGCGTGAACGGAGTA | 3658 | RQGVNGV | 4901 | 101.991 |
| 1166 | ACTGTGATGATGAGTACGAGG | 3659 | TVMMSTR | 4902 | 101.976 |
| 1167 | TGGCAAGACCACAACAAAGTC | 3660 | WQDHNKV | 4903 | 101.948 |
| 1168 | GGAATCACAGGATCAACAGGA | 3661 | GITGSTG | 4904 | 101.943 |
| 1169 | AATTATGCTCAGAGGGATGGT | 3662 | NYAQRDG | 4905 | 101.936 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1170 | AAACAAGAAGCTCTGTCCTCA | 3663 | KQEALSS | 4906 | 101.872 |
| 1171 | TCAACTTTAGACCGAAGCGAA | 3664 | STLDRSE | 4907 | 101.8665 |
| 1172 | GCGATTACGAATACGCAGCAG | 3665 | AITNTQQ | 4908 | 101.8615 |
| 1173 | AGGCTGGCGACTCAGAGTGCT | 3666 | RLATQSA | 4909 | 101.847 |
| 1174 | TGGCAGCTTACGACGAGTCAT | 3667 | WQLTTSH | 4910 | 101.775 |
| 1175 | GGTGGTAGTGGTTCTAATACT | 3668 | GGSGSNT | 4911 | 101.759 |
| 1176 | AACTTAGTAGCGTACACGAAA | 3669 | NLVAYTK | 4912 | 101.732 |
| 1177 | AAGGCTTCGCATGATACTAGT | 3670 | KASHDTS | 4913 | 101.721 |
| 1178 | GCCATAACGATAATAGGCACT | 3671 | AITIIGT | 4914 | 101.711 |
| 1179 | AACGCATCGTCGGACCGCTTC | 3672 | NASSDRF | 4915 | 101.686 |
| 1180 | GAAACGCAACGTATCGAACTG | 3673 | ETQRIEL | 4916 | 101.636 |
| 1181 | GTGATTGAGGTTAATTCGCGT | 3674 | VIEVNSR | 4917 | 101.614 |
| 1182 | GATAGGGATATGGAGGGTGTT | 3675 | DRDMEGV | 4918 | 101.609 |
| 1183 | ATTTCGGAGATGACGCGGTAT | 3676 | ISEMTRY | 4919 | 101.59 |
| 1184 | GAGCATGATGTGAGTACGCGT | 3677 | EHDVSTR | 4920 | 101.539 |
| 1185 | CGTATGGAGGAGACTGCTTAT | 3678 | RMEETAY | 4921 | 101.533 |
| 1186 | TATAGTACTGATCTTAGGATG | 3679 | YSTDLRM | 4922 | 101.52 |
| 1187 | GTGCCTGAGCCTAAGAAGGCG | 3680 | VPEPKKA | 4923 | 101.495 |
| 1188 | ACTTATGCGCCTAGGTCGCCT | 3681 | TYAPRSP | 4924 | 101.484 |
| 1189 | GCTGCGGCTTCGCCTTTGGCT | 3682 | AAASPLA | 4925 | 101.484 |
| 1190 | AGTGGGACGTATGCTAGTCGT | 3683 | SGTYASR | 4926 | 101.456 |
| 1191 | ACTGAAGCATCAATCGCGGCG | 3684 | TEASIAA | 4927 | 101.456 |
| 1192 | CGCATCGTAGACACGTTGGGA | 3685 | RIVDTLG | 4928 | 101.447 |
| 1193 | TATCTGCAGGAGAAGTTTCCT | 3686 | YLQEKFP | 4929 | 101.437 |
| 1194 | GTTCATGATCAGGGGCTGGG | 3687 | VHDQGAG | 4930 | 101.436 |
| 1195 | CCCCAAGCCACTCTCAACAAC | 3688 | PQATLNN | 4931 | 101.432 |
| 1196 | TGCGGAATGTCCGAATGCTCG | 3689 | CGMSECS | 4932 | 101.429 |
| 1197 | GGTTCGCACAACGGGCCGACA | 3690 | GSHNGPT | 4933 | 101.429 |
| 1198 | TTTGGGTCTGGGCCGAATCTT | 3691 | FGSGPNL | 4934 | 101.413 |
| 1199 | ATGGATACGAATACGCATCGT | 3692 | MDTNTHR | 4935 | 101.411 |
| 1200 | AAGAATAATCCTGAGGATGGT | 3693 | KNNPEDG | 4936 | 101.41 |
| 1201 | CTGCCTACGGCTACTGGTCAG | 3694 | LPTATGQ | 4937 | 101.406 |
| 1202 | ACGGCTGAGCGTACTGAGTAT | 3695 | TAERTEY | 4938 | 101.383 |
| 1203 | AACTACAGGGACATCACAATG | 3696 | NYRDITM | 4939 | 101.375 |
| 1204 | CCCGCGAGAAGCGACGCCCTT | 3697 | PARSDAL | 4940 | 101.359 |
| 1205 | TCCGTTGTAACTCTTGGGGTG | 3698 | SVVTLGV | 4941 | 101.324 |
| 1206 | GTTGTTAAGGAGATTAAGCTG | 3699 | VVKEIKL | 4942 | 101.324 |

TABLE 2-continued

MHCK7 Results mRNA Second Round of Capsid Variant Selection in
C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1207 | GACCACTCGAAACAAAACTCT | 3700 | DHSKQNS | 4943 | 101.293 |
| 1208 | CAGTCTAATTTGGTTATTAAT | 3701 | QSNLVIN | 4944 | 101.292 |
| 1209 | ATTCCGGTTGGGGCGATGGCT | 3702 | IPVGAMA | 4945 | 101.286 |
| 1210 | ACGTCGGAGATGCGTACTGCT | 3703 | TSEMRTA | 4946 | 101.255 |
| 1211 | GGTAGTCAGCGTGCTATGAAT | 3704 | GSQRAMN | 4947 | 101.251 |
| 1212 | CACCTGTCACAAGCAAACCAC | 3705 | HLSQANH | 4948 | 101.24 |
| 1213 | GGAGGGAACTCCCACGGGGTA | 3706 | GGNSHGV | 4949 | 101.219 |
| 1214 | GTGACTCGTAGTACGAAGGAG | 3707 | VTRSTKE | 4950 | 101.178 |
| 1215 | ATGCTCAGAGCAAGCACCGCC | 3708 | MLRASTA | 4951 | 101.171 |
| 1216 | GGCAGGCAAATACCAGAACAA | 3709 | GRQIPEQ | 4952 | 101.146 |
| 1217 | TGGAATCAGAATGTGTCTCAT | 3710 | WNQNVSH | 4953 | 101.125 |
| 1218 | CAGCGGGGGGAGCTTCCTGCG | 3711 | QRGELPA | 4954 | 101.114 |
| 1219 | GCGAATGATAGTTTGCGTTCT | 3712 | ANDSLRS | 4955 | 101.079 |
| 1220 | AACATGCCACCGGAATCGCAC | 3713 | NMPPESH | 4956 | 101.037 |
| 1221 | AATTTGAGTCTTCAGAGTCTG | 3714 | NLSLQSL | 4957 | 101.03 |
| 1222 | ACATCAGACGGTCTACTAAGT | 3715 | TSDGLLS | 4958 | 101.028 |
| 1223 | GCGGGCCAAGCGTACCAATCC | 3716 | AGQAYQS | 4959 | 101.016 |
| 1224 | CTGAGTGTGAAGGAGGAGATT | 3717 | LSVKEEI | 4960 | 101.007 |
| 1225 | GATAATAGTCCTGCTAATCAT | 3718 | DNSPANH | 4961 | 100.9812 |
| 1226 | ATGCACAACCTACCCTCATAC | 3719 | MHNLPSY | 4962 | 100.9629 |
| 1227 | TACCAAGCCTCAAACAACAGT | 3720 | YQASNNS | 4963 | 100.9594 |
| 1228 | GCGCGGGCAGAAGGGGTCTTC | 3721 | ARAEGVF | 4964 | 100.9325 |
| 1229 | GGCCGAGAAGGAAACCTACCA | 3722 | GREGNLP | 4965 | 100.913 |
| 1230 | CAAGCTGCAGAAAGGGACAGA | 3723 | QAAERDR | 4966 | 100.8877 |
| 1231 | GTTGAGAATAATCGTATGAGT | 3724 | VENNRMS | 4967 | 100.8183 |
| 1232 | AATATGTCGCATAGTACTCTG | 3725 | NMSHSTL | 4968 | 100.7704 |
| 1233 | TCTTCGTTGGGTCTTGCTCCG | 3726 | SSLGLAP | 4969 | 100.7249 |
| 1234 | AACGTCGCTCCCTACAGTAGC | 3727 | NVAPYSS | 4970 | 100.7069 |
| 1235 | AGGCCTGCGCAGCTGCCTGAG | 3728 | RPAQLPE | 4971 | 100.615 |
| 1236 | ATGTCGGGTTCTGGGAACGCA | 3729 | MSGSGNA | 4972 | 100.597 |
| 1237 | CACGGGGGGAACACCGGAAC | 3730 | HGGEHRN | 4973 | 100.5793 |
| 1238 | GCATCCGGCGCACGCTACGTC | 3731 | ASGARYV | 4974 | 100.5302 |
| 1239 | CAAAACCACGCGTCTGGTGAA | 3732 | QNHASGE | 4975 | 100.499 |
| 1240 | GCACACCAAAAAGACCTACGC | 3733 | AHQKDLR | 4976 | 100.4529 |
| 1241 | TTTGGGAAGGTTGGTACTGCT | 3734 | FGKVGTA | 4977 | 100.433 |

TABLE 2-continued

MHCK7 Results mRNA Second Round of Capsid Variant Selection in C57BL6 mice-score capped at 100

| Variant ID | Nucleotide Sequence | SEQ ID NO: | aa | SEQ ID NO: | Sum of muscle mRNA score_capped at 100 |
|---|---|---|---|---|---|
| 1242 | CTGCAGAAGTCGACTCTGGCT | 3735 | LQKSTLA | 4978 | 100.3439 |
| 1243 | ATTCATAATGAGTCTTATGGT | 3736 | IHNESYG | 4979 | 100.15 |

TABLE 3

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1 | AGGGGTGATCTTTCTACGCCT | 4980 | RGDLSTP | 6647 | 856.3525 |
| 2 | AGAGGCGACTTATCCACACCC | 4981 | RGDLSTP | 6648 | 732.672 |
| 3 | AGAGGAGACTTGACAACCCCA | 4982 | RGDLTTP | 6649 | 683.373 |
| 4 | AGGGGCGACCTGAACCAATAC | 4983 | RGDLNQY | 6650 | 680.6265 |
| 5 | CGGGGTGATCAGCTTTATCAT | 4984 | RGDQLYH | 6651 | 624.3915 |
| 6 | AGGGGGGATGCGACGGAGCTT | 4985 | RGDATEL | 6652 | 620.5 |
| 7 | CGAGGAGACACCATGAGCAAA | 4986 | RGDTMSK | 6653 | 599.497 |
| 8 | CGGGGTGATCTTAATCAGTAT | 4987 | RGDLNQY | 6654 | 579.731 |
| 9 | CGGGGTGATCTTACTACGCCT | 4988 | RGDLTTP | 6655 | 531.1525 |
| 10 | CGCGGCGACATGATAAACACC | 4989 | RGDMINT | 6656 | 528.2405 |
| 11 | CGGGGGGATACTATGTCTAAG | 4990 | RGDTMSK | 6657 | 469.5075 |
| 12 | CGAGGCGACACAATGAACTAC | 4991 | RGDTMNY | 6658 | 412.3247 |
| 13 | CGGGGTGACGCAACAGAATTG | 4992 | RGDATEL | 6659 | 408.0865 |
| 14 | CGTTTGGACCTGCAAGTCCAC | 4993 | RLDLQVH | 6660 | 397.178 |
| 15 | CGTGGTGATGTGGCGGCTAAG | 4994 | RGDVAAK | 6661 | 395.174 |
| 16 | AGGGGCGACCTCAACGACAGC | 4995 | RGDLNDS | 6662 | 360.4535 |
| 17 | CGTGGGGATTTGAATGATTCT | 4996 | RGDLNDS | 6663 | 349.6835 |
| 18 | TCTTATGGTAATACTCATGAT | 4997 | SYGNTHD | 6664 | 326.826 |
| 19 | CGTTTGGACCTGCAAGTCAAC | 4998 | RLDLQVN | 6665 | 317.78 |
| 20 | AAAGCGGGACAACTAGTGGAA | 4999 | KAGQLVE | 6666 | 317.023 |
| 21 | GATCAGACGGCTAGTATTGTT | 5000 | DQTASIV | 6667 | 313.224 |
| 22 | TATATTGCTGCGGGTGAGCAG | 5001 | YIAAGEQ | 6668 | 308.738 |
| 23 | GCGGTTGTTCTGAATAGTAAT | 5002 | AVVLNSN | 6669 | 307.8445 |
| 24 | TCTAAAGGAAACGAACAAATG | 5003 | SKGNEQM | 6670 | 305.016 |
| 25 | GCAAACCCCAACATACTAGAC | 5004 | ANPNILD | 6671 | 302.02 |
| 26 | CACAACAAACCAAACGGAGAC | 5005 | HNKPNGD | 6672 | 297.851 |
| 27 | GATAAGACTGAGATGCTGCAG | 5006 | DKTEMLQ | 6673 | 294.655 |
| 28 | ACAGAACAATCTTACTCACGA | 5007 | TEQSYSR | 6674 | 290.3555 |
| 29 | ACTGTGATGATGAGTACGAGG | 5008 | TVMMSTR | 6675 | 289.3945 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 30 | GTCTCTACATACCTCCTGGCA | 5009 | VSTYLLA | 6676 | 286.859 |
| 31 | CCTAATGTTACGCAGTCTTAT | 5010 | PNVTQSY | 6677 | 285.178 |
| 32 | ATGAGTAATTTGGGGTATGAG | 5011 | MSNLGYE | 6678 | 284 |
| 33 | ACGATGGGTGCTAATGGTACT | 5012 | TMGANGT | 6679 | 278.291 |
| 34 | AATGTTAATGCGCAGAGTAGG | 5013 | NVNAQSR | 6680 | 275.45 |
| 35 | GACCAAAACTTCGAACGTAGA | 5014 | DQNFERR | 6681 | 274.6045 |
| 36 | AACACGTACACACCGGGAAAA | 5015 | NTYTPGK | 6682 | 273.83545 |
| 37 | CGTGGGGATATGATTAATACG | 5016 | RGDMINT | 6683 | 270.333 |
| 38 | GCACAATTCGAATCAGGCCGA | 5017 | AQFESGR | 6684 | 267.7345 |
| 39 | ACGGCGTATCAGGCTGGTCTG | 5018 | TAYQAGL | 6685 | 267.054 |
| 40 | AGTGTTAGTTCTGTGGTGTTG | 5019 | SVSSVVL | 6686 | 266.91 |
| 41 | GGGCTTTCTAAGGCGTCTGAT | 5020 | GLSKASD | 6687 | 266.825 |
| 42 | TGGAACGGAAACGCCACACAA | 5021 | WNGNATQ | 6688 | 265.11 |
| 43 | ACAGCCGGCGGCGAACGCGCC | 5022 | TAGGERA | 6689 | 258.785 |
| 44 | TACACCTCTCAAACCAGCACT | 5023 | YTSQTST | 6690 | 258.1818 |
| 45 | GCGAACATAGAAAACACGTCA | 5024 | ANIENTS | 6691 | 257.015 |
| 46 | GAACTCTCCGTTCCGAAACCA | 5025 | ELSVPKP | 6692 | 255.133 |
| 47 | GATCCTGGTCGGACGGGTACG | 5026 | DPGRTGT | 6693 | 254.7 |
| 48 | GATCGTCCGAATAATATGACG | 5027 | DRPNNMT | 6694 | 254.383 |
| 49 | TATAGTACTGATCTTAGGATG | 5028 | YSTDLRM | 6695 | 252.146 |
| 50 | CAGTCGGTTAATAGTACGAGT | 5029 | QSVNSTS | 6696 | 251.508 |
| 51 | GCGGCACAACTCGTCAGTCCA | 5030 | AAQLVSP | 6697 | 250.413 |
| 52 | CTCGGAGGAAACAGCAGGTTC | 5031 | LGGNSRF | 6698 | 247.9775 |
| 53 | GCGACGCTGAATAATAGTTAT | 5032 | ATLNNSY | 6699 | 247.2955 |
| 54 | CGCTTGGACGTTGGAAGCCCG | 5033 | RLDVGSP | 6700 | 245.839 |
| 55 | TATCGGGGTAGGGAGGATTGG | 5034 | YRGREDW | 6701 | 244.83 |
| 56 | AGGGGAGATCTTTCTACGCCT | 5035 | RGDLSTP | 6702 | 243.25 |
| 57 | AGTGGTCTTTCGCATGGTCAG | 5036 | SGLSHGQ | 6703 | 242.486 |
| 58 | GAACACGCTACAGCAAAACAA | 5037 | EHATAKQ | 6704 | 241.816 |
| 59 | GGGGCGGAAGCGGGCCGCCAA | 5038 | GAEAGRQ | 6705 | 241.46345 |
| 60 | ATAAGCGGTTCCACTACACAC | 5039 | ISGSTTH | 6706 | 240.8811 |
| 61 | GGCACCGTCGTTCCGGGCTCC | 5040 | GTVVPGS | 6707 | 240.8455 |
| 62 | CATAATAATAATATGCTGAAT | 5041 | HNNNMLN | 6708 | 239.0755 |
| 63 | CGTCTGACTGATACTATGCAT | 5042 | RLTDTMH | 6709 | 238.939 |
| 64 | AACACCTACCCCTTCAACGCC | 5043 | NTYPFNA | 6710 | 235.89 |
| 65 | TCAACCACTACTGGCCACATG | 5044 | STTTGHM | 6711 | 231.581 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 66 | GTGCATAATCCTACTACTACG | 5045 | VHNPTTT | 6712 | 231.5537 |
| 67 | AATCTGCAGGTGAATGCGAAT | 5046 | NLQVNAN | 6713 | 231.172 |
| 68 | AGATACGGAGAATCCATCGAA | 5047 | RYGESIE | 6714 | 230.66 |
| 69 | AATACTACTCCGCCTAATCAT | 5048 | NTTPPNH | 6715 | 230.225 |
| 70 | AATACTTTGCAGAATAGTCAT | 5049 | NTLQNSH | 6716 | 229.0666 |
| 71 | AGTCTGAACAACATGGGATCG | 5050 | SLNNMGS | 6717 | 228.9154 |
| 72 | AGAAACGAAAACGTAAACGCT | 5051 | RNENVNA | 6718 | 228.828 |
| 73 | GCTGTGCATGCGACTAGTAGT | 5052 | AVHATSS | 6719 | 227.882 |
| 74 | ACCCAACACCTACCATCCACA | 5053 | TQHLPST | 6720 | 227.0845 |
| 75 | AGTGTGTTGTCTCAGGCTAAT | 5054 | SVLSQAN | 6721 | 225.4035 |
| 76 | AGTAGCTCAACTGAAGGGCAA | 5055 | SSSTEGQ | 6722 | 224.971 |
| 77 | GGTCGGACGGATACTCCTAAT | 5056 | GRTDTPN | 6723 | 224.945 |
| 78 | GTTCAAACCCACATAGGAGTC | 5057 | VQTHIGV | 6724 | 224.616 |
| 79 | ACTTCTGCTAGTGAGAATTGG | 5058 | TSASENW | 6725 | 224.608 |
| 80 | GGAAAAGCCAACGACGGTTCT | 5059 | GKANDGS | 6726 | 224.5935 |
| 81 | GTGGAGCGGAATACTGATATG | 5060 | VERNTDM | 6727 | 223.9975 |
| 82 | CAAAACCACGCGTCTGGTGAA | 5061 | QNHASGE | 6728 | 223.871 |
| 83 | TATTATGAGAAGCTTAGTGCG | 5062 | YYEKLSA | 6729 | 222.1725 |
| 84 | TTCATCGCTAACACTAACCCA | 5063 | FIANTNP | 6730 | 221.76 |
| 85 | ACCTCCACGGCTTCAAAACAA | 5064 | TSTASKQ | 6731 | 221.617 |
| 86 | AATAATGATAATGGTTTTGTT | 5065 | NNDNGFV | 6732 | 220.61 |
| 87 | GCTAATTCTATTGGGGGTCCG | 5066 | ANSIGGP | 6733 | 220.304 |
| 88 | ACTGGCCAATTAGTAGGAACC | 5067 | TGQLVGT | 6734 | 220.262 |
| 89 | TACAGTCAATCGCTGTCTGAA | 5068 | YSQSLSE | 6735 | 220.02 |
| 90 | GTCTACAACGGCAACGTAGTA | 5069 | VYNGNVV | 6736 | 219.824 |
| 91 | AACTCGGCTGAATCCTCGAGA | 5070 | NSAESSR | 6737 | 219.5415 |
| 92 | ACGCGTAATTTGTCTGAGAGT | 5071 | TRNLSES | 6738 | 218.919 |
| 93 | TCTATGTCTGATGGGCTTCGG | 5072 | SMSDGLR | 6739 | 218.868 |
| 94 | GTAGGCGACCAATCCCGCCCG | 5073 | VGDQSRP | 6740 | 218.8565 |
| 95 | TTTACGGTGAATCAGGATCTT | 5074 | FTVNQDL | 6741 | 218.069 |
| 96 | TATCATAAGTATAGTACGGAT | 5075 | YHKYSTD | 6742 | 217.64 |
| 97 | TATGGTGTGCAGGCGAATAGT | 5076 | YGVQANS | 6743 | 217.293 |
| 98 | TTGCAGACGCCTGGGACGACG | 5077 | LQTPGTT | 6744 | 217.179 |
| 99 | TATCAGCAGACTTCTAGTACG | 5078 | YQQTSST | 6745 | 216.8135 |
| 100 | CAAACGAACACCAACGACAGA | 5079 | QTNTNDR | 6746 | 216.664 |
| 101 | ATGGATAAGTCTAATAATTCT | 5080 | MDKSNNS | 6747 | 216.638 |
| 102 | CATCTTAGTCAGGCTAATCAT | 5081 | HLSQANH | 6748 | 216.575 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 103 | GTTGGTGCGAGTACGGCTTCG | 5082 | VGASTAS | 6749 | 215.9195 |
| 104 | CACAACAACAACCTGCAAAAC | 5083 | HNNNLQN | 6750 | 215.084 |
| 105 | AGTACTTATGGGAATACTTAT | 5084 | STYGNTY | 6751 | 214.971 |
| 106 | CGGGCTGATGTTTCTTGGTCT | 5085 | RADVSWS | 6752 | 214.499 |
| 107 | CGAGGAGACAACAGCACACCG | 5086 | RGDNSTP | 6753 | 214.29 |
| 108 | GGTCGGGATTATGCTATGAGT | 5087 | GRDYAMS | 6754 | 214.166 |
| 109 | CCTAACAACGAAAAAAACCCG | 5088 | PNNEKNP | 6755 | 214.048 |
| 110 | GATAATGTGAATTCTCAGCCT | 5089 | DNVNSQP | 6756 | 213.6615 |
| 111 | ATGGGGACTGAGTATCGTATG | 5090 | MGTEYRM | 6757 | 213.606 |
| 112 | AATCAGAGTATTAATAATATT | 5091 | NQSINNI | 6758 | 213.36 |
| 113 | GCCATAGACTCTATCAAACAA | 5092 | AIDSIKQ | 6759 | 213.304 |
| 114 | GTTGAGTCTTCTTATTCTCGG | 5093 | VESSYSR | 6760 | 212.9405 |
| 115 | GGTCAGTATAGTCAGACGCTT | 5094 | GQYSQTL | 6761 | 212.242 |
| 116 | ACCATCCAAGACCACATAAAA | 5095 | TIQDHIK | 6762 | 212.116 |
| 117 | AACAGTTCCCAATGGCCCAAC | 5096 | NSSQWPN | 6763 | 211.938 |
| 118 | ACGGATAATGGTCTTCTTGTG | 5097 | TDNGLLV | 6764 | 211.787 |
| 119 | GTAAGAGAAACCACACACCTC | 5098 | VRETTHL | 6765 | 211.44 |
| 120 | CGTGGTGATATGACTCGTGCG | 5099 | RGDMTRA | 6766 | 211.181 |
| 121 | ACTTATGGTATTACTCATGAT | 5100 | TYGITHD | 6767 | 210.641 |
| 122 | ACGGCGCTGAATACGTATCCT | 5101 | TALNTYP | 6768 | 210.568 |
| 123 | GGTGGCGAAAACAGAACCCCA | 5102 | GGENRTP | 6769 | 210.4 |
| 124 | TATCTGCAGGAGAAGTTTCCT | 5103 | YLQEKFP | 6770 | 210.3715 |
| 125 | CTTAATCTTACTAATCATAAT | 5104 | LNLTNHN | 6771 | 209.727 |
| 126 | GGATTAGCTAGTCTACACCTG | 5105 | GLASLHL | 6772 | 209.3585 |
| 127 | GTAGAACACGTAGCCCACCAA | 5106 | VEHVAHQ | 6773 | 209.322 |
| 128 | AGCGAACACCACGCCGGAATA | 5107 | SEHHAGI | 6774 | 209.188 |
| 129 | GAAGCGTCCAACTACGAACGA | 5108 | EASNYER | 6775 | 208.926 |
| 130 | CCCTCCAACAGTGAAAGATTC | 5109 | PSNSERF | 6776 | 208.6635 |
| 131 | TCCCCCGGCAACGGGTTGCTA | 5110 | SPGNGLL | 6777 | 208.4985 |
| 132 | ATACTGAAATCCGACGCACCA | 5111 | ILKSDAP | 6778 | 208.297 |
| 133 | TTTGATAGTGCGAATGGTCGG | 5112 | FDSANGR | 6779 | 208.26 |
| 134 | GATGGTAAGACTACGTCTAAT | 5113 | DGKTTSN | 6780 | 207.768 |
| 135 | ACTAATTATCCTGAGGCGAAT | 5114 | TNYPEAN | 6781 | 207.706 |
| 136 | CGAGGAGACCACAGCACACCG | 5115 | RGDHSTP | 6782 | 207.4315 |
| 137 | CAGACGACTATTCTGGCTGCT | 5116 | QTTILAA | 6783 | 207.223 |
| 138 | GCTACTGCGCATCAGGATGGT | 5117 | ATAHQDG | 6784 | 207.212 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 139 | CAAGCCCTGGCCACCACAAAC | 5118 | QALATTN | 6785 | 207.096 |
| 140 | TATAATGCTACTCCTTCGCAG | 5119 | YNATPSQ | 6786 | 206.964 |
| 141 | GAGCTGTCTACTCCTATGGTT | 5120 | ELSTPMV | 6787 | 206.8655 |
| 142 | ATTAATATTAGTAGTGATTTT | 5121 | INISSDF | 6788 | 206.753 |
| 143 | GTAACGGCACACCAATTATCC | 5122 | VTAHQLS | 6789 | 206.7385 |
| 144 | GGAGAAAGCTCCTCAATAAGC | 5123 | GESSSIS | 6790 | 206.656 |
| 145 | GAATCCCTCCCAATCTCTAAA | 5124 | ESLPISK | 6791 | 206.576 |
| 146 | ACGAATGTTAGTACGCTTTTG | 5125 | TNVSTLL | 6792 | 206.455 |
| 147 | TGGCAGACGAATGGTATGCAG | 5126 | WQTNGMQ | 6793 | 206.4378 |
| 148 | TACAGGATGGAAACGAACCCA | 5127 | YRMETNP | 6794 | 206.121 |
| 149 | ATAACCGGCAACACCGTCGGA | 5128 | ITGNTVG | 6795 | 205.9135 |
| 150 | CTGAACACTCTAATCCACAAA | 5129 | LNTLIHK | 6796 | 205.873 |
| 151 | GGGACTTCCTTGGAAAACCGA | 5130 | GTSLENR | 6797 | 205.8535 |
| 152 | TACCAACACAACCAAGCCCAC | 5131 | YQHNQAH | 6798 | 205.473 |
| 153 | ATTGAGAGTAAGACTGTGCAG | 5132 | IESKTVQ | 6799 | 205.0365 |
| 154 | TATACGCAGGGTATTATGAAT | 5133 | YTQGIMN | 6800 | 204.5275 |
| 155 | AGTACGAATGAGGCTCCTAAG | 5134 | STNEAPK | 6801 | 204.522 |
| 156 | TTGTCTCAGAATTTTAATCCT | 5135 | LSQNFNP | 6802 | 204.3926 |
| 157 | TACTCTTCTGAAATGAGCGAA | 5136 | YSSEMSE | 6803 | 204.31 |
| 158 | TCATACGGAGGATCTGGCCCC | 5137 | SYGGSGP | 6804 | 204.28 |
| 159 | ATGGACGCTGCGTACGGTAGT | 5138 | MDAAYGS | 6805 | 203.959 |
| 160 | CCTTTTAATCCTGGGAATGTG | 5139 | PFNPGNV | 6806 | 203.2041 |
| 161 | CAAAAATCGGAAACCTACACT | 5140 | QKSETYT | 6807 | 203.1248 |
| 162 | AACAAAGACCACAACCACCTG | 5141 | NKDHNHL | 6808 | 202.8605 |
| 163 | CTAACCGGCTCTGACATGAAA | 5142 | LTGSDMK | 6809 | 202.379 |
| 164 | TCTAAGGATAGTACTATGTAT | 5143 | SKDSTMY | 6810 | 202.335 |
| 165 | GAAGCATTCCCGCGAGCGGGC | 5144 | EAFPRAG | 6811 | 202.275 |
| 166 | GAACACACTCACTTAAACCCG | 5145 | EHTHLNP | 6812 | 201.959 |
| 167 | AGTTCGGACCCAAAAGGTCAA | 5146 | SSDPKGQ | 6813 | 201.825 |
| 168 | AAAACCATCGACATAGCACAA | 5147 | KTIDIAQ | 6814 | 201.699 |
| 169 | ACCGGTAGCTTGAACTCTATG | 5148 | TGSLNSM | 6815 | 201.671 |
| 170 | ATGCAACGCGAAGACGCGAAC | 5149 | MQREDAN | 6816 | 201.523 |
| 171 | GCCTCTACAGTCTCACTCTAC | 5150 | ASTVSLY | 6817 | 201.407 |
| 172 | GGCCGTGACGACCTCACAAAC | 5151 | GRDDLTN | 6818 | 200.911 |
| 173 | TCTAATCCGGGTAATCATAAT | 5152 | SNPGNHN | 6819 | 200.872 |
| 174 | GATACTTATAAGGGTAAGTGG | 5153 | DTYKGKW | 6820 | 200.7787 |
| 175 | CCACCCAACGGCAGCAGTAGA | 5154 | PPNGSSR | 6821 | 200.32615 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 176 | GCTTCTTATAGTATTTCTGAT | 5155 | ASYSISD | 6822 | 200.269 |
| 177 | GTGACTGTTAGTCTGGATGGG | 5156 | VTVSLDG | 6823 | 200.021 |
| 178 | ATGGCCATAGGCCACTCCCCA | 5157 | MAIGHSP | 6824 | 200 |
| 179 | TTTCGGACGGTGTATACTGGT | 5158 | FRTVYTG | 6825 | 200 |
| 180 | AAAAAACGGCAGCCCATCGCC | 5159 | KKRQPIA | 6826 | 200 |
| 181 | AAAAATAAGCTCTACTATGGC | 5160 | KNKLYYG | 6827 | 200 |
| 182 | TCTACATCTCCGGTTAACAGC | 5161 | STSPVNS | 6828 | 200 |
| 183 | GGGTCTGGGATTGCGGGGACT | 5162 | GSGIAGT | 6829 | 200 |
| 184 | ATCGACGTACTGAACGGAAGT | 5163 | IDVLNGS | 6830 | 200 |
| 185 | GGTCATAATATGGCACAGGCG | 5164 | GHNMAQA | 6831 | 200 |
| 186 | ACGAGGAGCAACTCCGACGAA | 5165 | TRSNSDE | 6832 | 200 |
| 187 | GGAGCAAAAGGAACCATGGGC | 5166 | GAKGTMG | 6833 | 200 |
| 188 | GCTACTACTCTTACTGGTGAT | 5167 | ATTLTGD | 6834 | 200 |
| 189 | TTCAACACATCGTCGGAATTC | 5168 | FNTSSEF | 6835 | 200 |
| 190 | TATACGGCGCAGACCGGCTGG | 5169 | YTAQTGW | 6836 | 200 |
| 191 | CGAGTAAACAACGACGCAATA | 5170 | RVNNDAI | 6837 | 200 |
| 192 | ACTATTCAGCTTACTGATACT | 5171 | TIQLTDT | 6838 | 200 |
| 193 | GCCAGCATGCCCTCTGTAGAC | 5172 | ASMPSVD | 6839 | 200 |
| 194 | AATCAGGTGGGTGCGTCTGCG | 5173 | NQVGASA | 6840 | 200 |
| 195 | GGAAACATGGTGACTCCAAAC | 5174 | GNMVTPN | 6841 | 200 |
| 196 | CGTGGTGACCAAGGCACACAC | 5175 | RGDQGTH | 6842 | 200 |
| 197 | TCGAGTGATTCTCGTATTCCG | 5176 | SSDSRIP | 6843 | 200 |
| 198 | GGACTGCACGGCACCAACGCA | 5177 | GLHGTNA | 6844 | 200 |
| 199 | TCTAGTTATCAGTCTGGGCTG | 5178 | SSYQSGL | 6845 | 199.609 |
| 200 | ACAGCCTACTCGCCCACAGTC | 5179 | TAYSPTV | 6846 | 199.236 |
| 201 | CGCAGTGACACCACTAACGCC | 5180 | RSDTTNA | 6847 | 198.59 |
| 202 | CGTATTGTGGCTAATGAGCAG | 5181 | RIVANEQ | 6848 | 197.795 |
| 203 | ATCCACAACGAATCATACGTC | 5182 | IHNESYV | 6849 | 197.72 |
| 204 | CAGCAGAATACGCGTTTGCCG | 5183 | QQNTRLP | 6850 | 197.4665 |
| 205 | GGTATCAACTCCTCACACTTC | 5184 | GINSSHF | 6851 | 197.224 |
| 206 | GGTATGACTTCTAATCAGGTT | 5185 | GMTSNQV | 6852 | 196.916 |
| 207 | AGGGAGATTGTTCATAGTAAT | 5186 | REIVHSN | 6853 | 196.5775 |
| 208 | GCAGAACACACGTACACGGTC | 5187 | AEHTYTV | 6854 | 196.501 |
| 209 | CCTGCTACGCTACACCTGACA | 5188 | PATLHLT | 6855 | 196.1975 |
| 210 | AAGCAGACTGATAGTAGGGGT | 5189 | KQTDSRG | 6856 | 196.15 |
| 211 | ACTATGGTAGAAGTACTGCCA | 5190 | TMVEVLP | 6857 | 195.586 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 212 | ATCCCAACCGGCCAAACTAGC | 5191 | IPTGQTS | 6858 | 195.499 |
| 213 | ATGATAAAACCAACATGTTG | 5192 | MIKTNML | 6859 | 195.198 |
| 214 | GCGGAACGACCCACTAGAGAC | 5193 | AERPTRD | 6860 | 194.842 |
| 215 | CGGGATCTGGGGCAGACCGGC | 5194 | RDLGQTG | 6861 | 194.34 |
| 216 | AATGAGGGGCGTGTGCAGACT | 5195 | NEGRVQT | 6862 | 194.00545 |
| 217 | ACTGCGGCTAGTACTGCGAGG | 5196 | TAASTAR | 6863 | 193.5855 |
| 218 | ACCCAAGGGAACAACATGGTA | 5197 | TQGNNMV | 6864 | 193.362 |
| 219 | CATAGTACTTTTCCTACGACT | 5198 | HSTFPTT | 6865 | 193.274 |
| 220 | CAATCTATCGGCCACCCCGTT | 5199 | QSIGHPV | 6866 | 191.64595 |
| 221 | TCGGGTGTTAATAGTGAGCGT | 5200 | SGVNSER | 6867 | 191.3763 |
| 222 | CCTCACGCCAACGGAGTGACA | 5201 | PHANGVT | 6868 | 191.349 |
| 223 | GACCACCAACAAGCCCTAGCT | 5202 | DHQQALA | 6869 | 191.305 |
| 224 | AGTCAGCAGGGTTTTACTCTG | 5203 | SQQGFTL | 6870 | 191.2955 |
| 225 | ACAAACGCTGCTCTAGTACCA | 5204 | TNAALVP | 6871 | 191.1973 |
| 226 | GGTGTTAGTAGTAATTCTGCG | 5205 | GVSSNSA | 6872 | 190.1595 |
| 227 | CATGATACGGTTGGGGAGAGG | 5206 | HDTVGER | 6873 | 189.859 |
| 228 | GCGTTAAACGCCCAAGGGATC | 5207 | ALNAQGI | 6874 | 189.3825 |
| 229 | CATGATAGTATGTGTTGTGCG | 5208 | HDSMCCA | 6875 | 189.35 |
| 230 | TACATCGCGGCAGGGGAACAA | 5209 | YIAAGEQ | 6876 | 189.046 |
| 231 | GAGAATGCTCGTGAGGGTGTG | 5210 | ENAREGV | 6877 | 188.331 |
| 232 | GCTACGGTTTATAATGAGTTG | 5211 | ATVYNEL | 6878 | 188.18 |
| 233 | GACACTAACGGAATAAAATCA | 5212 | DTNGIKS | 6879 | 187.628 |
| 234 | AAGCCGACTGCGAATGATTGG | 5213 | KPTANDW | 6880 | 187.4884 |
| 235 | TATGAGAGTACTCATGTTAAT | 5214 | YESTHVN | 6881 | 187.1195 |
| 236 | TACACCAACGGGGGCCACCTA | 5215 | YTNGGHL | 6882 | 187.0304 |
| 237 | GTAGACAAATCTAGCCCAGTG | 5216 | VDKSSPV | 6883 | 186.9365 |
| 238 | CCAATCCAAAACGAATCGTCC | 5217 | PIQNESS | 6884 | 186.748 |
| 239 | ATACACAAATCTAGCGTCGAA | 5218 | IHKSSVE | 6885 | 186.654 |
| 240 | CATGATATTAGTCTGGATCGT | 5219 | HDISLDR | 6886 | 186.65 |
| 241 | TGGTGAGGGCTGAGTTTGCC | 5220 | W*GAEFA | 6887 | 186.1 |
| 242 | TACTCTCAATCCATAAAAAAC | 5221 | YSQSIKN | 6888 | 186.0095 |
| 243 | GCCCAAGACAACAACCACGAC | 5222 | AQDNNHD | 6889 | 185.6231 |
| 244 | GGGCAGAAGGAGACTACTGCG | 5223 | GQKETTA | 6890 | 184.948 |
| 245 | AAAAGCGAAGTACCCGCCCGA | 5224 | KSEVPAR | 6891 | 184.116 |
| 246 | GAACTTAACACCGCACACGCA | 5225 | ELNTAHA | 6892 | 184.059 |
| 247 | AGCACAAACGCGGGACAAAGG | 5226 | STNAGQR | 6893 | 183.7145 |
| 248 | AAGGCGGTTTCGGAGATTATT | 5227 | KAVSEII | 6894 | 183.539 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 249 | ACCTTCACGGTCGACGGTAGA | 5228 | TFTVDGR | 6895 | 183.2535 |
| 250 | AGTACGAGTGGTTATAATACT | 5229 | STSGYNT | 6896 | 182.703 |
| 251 | AATCATAGTCTGTCGGAGCAT | 5230 | NHSLSEH | 6897 | 182.427 |
| 252 | TCTATGCAGGATCCTTCTTTG | 5231 | SMQDPSL | 6898 | 182.375 |
| 253 | GAACAACAAAAAACAGACAAC | 5232 | EQQKTDN | 6899 | 182.331 |
| 254 | GCTGTTGTGAATGAGAATATG | 5233 | AVVNENM | 6900 | 182.3 |
| 255 | GGTCCCGGAGAAAACTACCGA | 5234 | GPGENYR | 6901 | 182.165 |
| 256 | TACAACGCAGGCGGAGAACAA | 5235 | YNAGGEQ | 6902 | 182.14 |
| 257 | GTCCTCTCCTCCAACCTGTAC | 5236 | VLSSNLY | 6903 | 181.3605 |
| 258 | GGTCTTTATCAGAATCCTACG | 5237 | GLYQNPT | 6904 | 181.2475 |
| 259 | AGTTCGGGGAGTTTGATTACT | 5238 | SSGSLIT | 6905 | 180.8125 |
| 260 | TATAATACGGATCGGACTAAT | 5239 | YNTDRTN | 6906 | 180.0485 |
| 261 | GAGAAGCCTCAGCATAATAGT | 5240 | EKPQHNS | 6907 | 179.9715 |
| 262 | GCGGCTTATGAGCATGCGCCT | 5241 | AAYEHAP | 6908 | 178.7065 |
| 263 | GGCGGCAACTACAACACAACT | 5242 | GGNYNTT | 6909 | 178.62 |
| 264 | TATCTGAATAGTACGCAGATT | 5243 | YLNSTQI | 6910 | 178.4905 |
| 265 | TCTAATTCTAATACTGCTGCT | 5244 | SNSNTAA | 6911 | 178.119 |
| 266 | TCGGATAATAGGAATACTGCG | 5245 | SDNRNTA | 6912 | 178.09355 |
| 267 | CGCTCGTTGGACAGCGGGATG | 5246 | RSLDSGM | 6913 | 177.6395 |
| 268 | GTTATGGATACGCATGGGATG | 5247 | VMDTHGM | 6914 | 177.54 |
| 269 | CATGTTACGGCGGTGGTTGAT | 5248 | HVTAVVD | 6915 | 177.447 |
| 270 | AGTATCACCCACAGCAACACC | 5249 | SITHSNT | 6916 | 177.4093 |
| 271 | GGATACGGCAGTTACAGCAAC | 5250 | GYGSYSN | 6917 | 177.0995 |
| 272 | CGTTGGTCTGAAAACAACTCC | 5251 | RWSENNS | 6918 | 176.788 |
| 273 | ATGTCTAGCCACACCGTCCAA | 5252 | MSSHTVQ | 6919 | 176.741 |
| 274 | TATGTTAGGGCGCAGGATCAG | 5253 | YVRAQDQ | 6920 | 176.713 |
| 275 | TTTGAGGGTGATAAGACTTAT | 5254 | FEGDKTY | 6921 | 176.655 |
| 276 | GTTAGCTCCGGCCACACGAAA | 5255 | VSSGHTK | 6922 | 176.4715 |
| 277 | TCGATGAACCTGCCAACTTCA | 5256 | SMNLPTS | 6923 | 176.425 |
| 278 | CTGAATCCTCAGCATGAGTTG | 5257 | LNPQHEL | 6924 | 176.19 |
| 279 | CTTCCGCCTGCGTCGGCGGGT | 5258 | LPPASAG | 6925 | 176.057 |
| 280 | GGAGGGAACTCCCACGGGGTA | 5259 | GGNSHGV | 6926 | 175.7625 |
| 281 | GGGGGTACGGGGTTGTCGAAG | 5260 | GGTGLSK | 6927 | 175.714 |
| 282 | AGTTTGAATTCTTCGAGTACT | 5261 | SLNSSST | 6928 | 175.4585 |
| 283 | ATGCCTAGTGAACCACCAGGG | 5262 | MPSEPPG | 6929 | 175.45 |
| 284 | GTTGTGCATTCGAGTATTACT | 5263 | VVHSSIT | 6930 | 175.18685 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 285 | TTGAGTCTGGCTGGGAATAGG | 5264 | LSLAGNR | 6931 | 175.0985 |
| 286 | GCGGACATGCAACACACCGTA | 5265 | ADMQHTV | 6932 | 175.003 |
| 287 | TTTCGTGATGGTCAGGGTATG | 5266 | FRDGQGM | 6933 | 174.983 |
| 288 | ACCGGAACAGCGATCTCCCGA | 5267 | TGTAISR | 6934 | 174.5465 |
| 289 | ATGGGGAAGCATGAGGGTCTT | 5268 | MGKHEGL | 6935 | 174.3418 |
| 290 | CCGGAATCCGCCGCCAAAAGC | 5269 | PESAAKS | 6936 | 174.268 |
| 291 | ACCCAAGCCTTCTCCCTAGGC | 5270 | TQAFSLG | 6937 | 174.2365 |
| 292 | ACTGATGGTATTTTTCAGCCT | 5271 | TDGIFQP | 6938 | 174.014 |
| 293 | GGGAGCCCAGTGATAGTAAAC | 5272 | GSPVIVN | 6939 | 173.652 |
| 294 | GGGCGTGATAATCATCATGCG | 5273 | GRDNHHA | 6940 | 173.4132 |
| 295 | CCGCGTTCTATTACGGAGTTG | 5274 | PRSITEL | 6941 | 173.403 |
| 296 | TGGGTAAACAGTGTGGGCAAC | 5275 | WVNSVGN | 6942 | 173.244 |
| 297 | GTTCATGGGACGTTGACTTAT | 5276 | VHGTLTY | 6943 | 173.1685 |
| 298 | GGTGTGTATATTGATGGTCGG | 5277 | GVYIDGR | 6944 | 173.081 |
| 299 | ATGAGTAATGATTTGCCTGGG | 5278 | MSNDLPG | 6945 | 172.671 |
| 300 | AATCGGTCGGATAGTTTTGCG | 5279 | NRSDSFA | 6946 | 172.6595 |
| 301 | GGGCAAACAAACGCAGTACAC | 5280 | GQTNAVH | 6947 | 172.4582 |
| 302 | TACGTCGACAAATCAATGACA | 5281 | YVDKSMT | 6948 | 172.1735 |
| 303 | AGTGTGATGGTGGGTACGAAT | 5282 | SVMVGTN | 6949 | 171.86 |
| 304 | ATTGGTCTGCAGAATTCTACT | 5283 | IGLQNST | 6950 | 171.84715 |
| 305 | AACGACCGACCGCTTGCCAGC | 5284 | NDRPLAS | 6951 | 171.464 |
| 306 | CTCATGGGCAGTCCAGGCGCG | 5285 | LMGSPGA | 6952 | 171.27 |
| 307 | ATTGATCGTAGTGCTAGTTTG | 5286 | IDRSASL | 6953 | 171.009 |
| 308 | ATTCAGGCGAAGAATTCTGAG | 5287 | IQAKNSE | 6954 | 170.983 |
| 309 | CATCAGTCTTTTGATGCTGGT | 5288 | HQSFDAG | 6955 | 170.699 |
| 310 | GCGGTTAATGAGACTAGGCTT | 5289 | AVNETRL | 6956 | 170.564 |
| 311 | ATCGCGTCAACGTGGAACATG | 5290 | IASTWNM | 6957 | 170.52 |
| 312 | AAAGTGGACATGACCTCCAAA | 5291 | KVDMTSK | 6958 | 170.4035 |
| 313 | TCTCATAGTATTACGGGTCTT | 5292 | SHSITGL | 6959 | 170.333 |
| 314 | ACTATTACTAGTCCGTCGGTG | 5293 | TITSPSV | 6960 | 170.18 |
| 315 | GAACACATCTCTAGCTACGGA | 5294 | EHISSYG | 6961 | 169.832 |
| 316 | TTCTCAACAAACTCTGTAATC | 5295 | FSTNSVI | 6962 | 169.7245 |
| 317 | TCGATGGAGGGTCAGCAGCAT | 5296 | SMEGQQH | 6963 | 169.71 |
| 318 | GTCGACAAAAGCGAAGCCGTC | 5297 | VDKSEAV | 6964 | 169.6265 |
| 319 | CAAGCTAACTTATCAATAATC | 5298 | QANLSII | 6965 | 169.3842 |
| 320 | GTTAAGGCGAGTGCTGGGGTT | 5299 | VKASAGV | 6966 | 169.1112 |
| 321 | TTTGGTACTTCTTATACGACT | 5300 | FGTSYTT | 6967 | 168.915 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 322 | GGGCTCACAGGATACCCAATG | 5301 | GLTGYPM | 6968 | 168.8625 |
| 323 | GCTATGGGAGCACTCGTGCAC | 5302 | AMGALVH | 6969 | 168.807 |
| 324 | GTATACGCCACCGCACTCGCA | 5303 | VYATALA | 6970 | 168.7005 |
| 325 | ACATTAACAGACGTTCACCGA | 5304 | TLTDVHR | 6971 | 168.7 |
| 326 | CCATCCTCAGCGGGTAGCACA | 5305 | PSSAGST | 6972 | 168.601 |
| 327 | AAAAAACGAAAACACTAACTA | 5306 | KKRKH*L | 6973 | 168.58 |
| 328 | GCTTATCAGCTGACTCCGGCT | 5307 | AYQLTPA | 6974 | 168.579 |
| 329 | CTTGCGCCTGATAATATTGGG | 5308 | LAPDNIG | 6975 | 168.515 |
| 330 | ACAATCGTTTCCGCTTACGCC | 5309 | TIVSAYA | 6976 | 168.3875 |
| 331 | GGTAATAATTTGAGTTTGTCT | 5310 | GNNLSLS | 6977 | 168.1503 |
| 332 | AGCACAAACACCGAACCTAGG | 5311 | STNTEPR | 6978 | 168.122 |
| 333 | TCTTTTCAGACGGATCGTGCG | 5312 | SFQTDRA | 6979 | 167.793 |
| 334 | TTCTTAGAAGGAGTCGCTCAA | 5313 | FLEGVAQ | 6980 | 167.647 |
| 335 | CAAGACGTAGGACGCACGAAC | 5314 | QDVGRTN | 6981 | 167.4595 |
| 336 | ACGCATGGTGATCATATTCAG | 5315 | THGDHIQ | 6982 | 167.197 |
| 337 | GTATCAGAAGGACAACGAATC | 5316 | VSEGQRI | 6983 | 167.049 |
| 338 | AACATGGGTCCAATGGGCCGG | 5317 | NMGPMGR | 6984 | 166.961 |
| 339 | CTACCCTCAACAGAAACTTTG | 5318 | LPSTETL | 6985 | 166.942 |
| 340 | GGTGGTATGTCGGCGCATTCG | 5319 | GGMSAHS | 6986 | 166.775 |
| 341 | GGGATGATCGGGCACAACGCA | 5320 | GMIGHNA | 6987 | 166.716 |
| 342 | ATAGACGAACGTTCCTCGATA | 5321 | IDERSSI | 6988 | 166.601 |
| 343 | CATGTGAATCCTACGCCGGCG | 5322 | HVNPTPA | 6989 | 166.586 |
| 344 | TGGTCGAGAACTGGAAACACC | 5323 | WSRTGNT | 6990 | 166.483 |
| 345 | ATCAAAGACTCGTACCTTACT | 5324 | IKDSYLT | 6991 | 166.205 |
| 346 | TTGAACCAAAACAGTGTCTCC | 5325 | LNQNSVS | 6992 | 166.174 |
| 347 | TCTGGTCCGATTCCTGCTGTT | 5326 | SGPIPAV | 6993 | 166.146 |
| 348 | ATGCAAGGGCTTAACAACATG | 5327 | MQGLNNM | 6994 | 165.268 |
| 349 | TCAAACAGCGGAGGCAACCAC | 5328 | SNSGGNH | 6995 | 165.1895 |
| 350 | ACGAGTACGATGACTGCGCGT | 5329 | TSTMTAR | 6996 | 165.115 |
| 351 | GAGAATAGTGATTTGTCTTAT | 5330 | ENSDLSY | 6997 | 165.08 |
| 352 | CATCCTGGGAATAGTTCTGTG | 5331 | HPGNSSV | 6998 | 165.062 |
| 353 | TTAACACCCCAAGGGACTAGT | 5332 | LTPQGTS | 6999 | 165.0315 |
| 354 | ACCGACACCCGAAAAAACGAC | 5333 | TDTRKND | 7000 | 164.843 |
| 355 | GGGGAGACGCTGAGGTCTCAG | 5334 | GETLRSQ | 7001 | 164.72165 |
| 356 | AGCGGTGTATCAGAAGGAAAC | 5335 | SGVSEGN | 7002 | 164.715 |
| 357 | ACTCAGTATGGTACTCTGCCG | 5336 | TQYGTLP | 7003 | 164.526 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 358 | GGGACGGTTAACTCAAGTGCA | 5337 | GTVNSSA | 7004 | 164.3765 |
| 359 | GGTAAAGCAACCTTAGTCCTC | 5338 | GKATLVL | 7005 | 164.3755 |
| 360 | GGTATATACCCGGCATCCACC | 5339 | GIYPAST | 7006 | 164.34 |
| 361 | GGTGTTATGTCTAATGCTACT | 5340 | GVMSNAT | 7007 | 164.06 |
| 362 | ACTCATGTGATTGGGGCTGTG | 5341 | THVIGAV | 7008 | 163.918 |
| 363 | ACTCGGAGTGATATTGGTGTG | 5342 | TRSDIGV | 7009 | 163.7255 |
| 364 | ACGCTTACATTATCTACCCTC | 5343 | TLTLSTL | 7010 | 163.5555 |
| 365 | TATAATGAGTCTTCGAATGCG | 5344 | YNESSNA | 7011 | 163.314 |
| 366 | TCGACGCAGGCGCAGACCGGC | 5345 | STQAQTG | 7012 | 163.15 |
| 367 | CGCGACATGATCAACTCATCA | 5346 | RDMINSS | 7013 | 162.984 |
| 368 | ACTAAGGGTAATAATCTGGTT | 5347 | TKGNNLV | 7014 | 162.899 |
| 369 | GGTTCTACGGTGTCGGCGCAG | 5348 | GSTVSAQ | 7015 | 162.631 |
| 370 | AGGGGTGATACTATGAATTAT | 5349 | RGDTMNY | 7016 | 162.425 |
| 371 | CATGCGGATGTGAATGCTGGG | 5350 | HADVNAG | 7017 | 161.99 |
| 372 | AGCGTTGTCAACACCAACATC | 5351 | SVVNTNI | 7018 | 161.9445 |
| 373 | TCTAATGTTCATGTTGTTAAT | 5352 | SNVHVVN | 7019 | 161.753 |
| 374 | TCGGTTGATAAGCCGCCGGGG | 5353 | SVDKPPG | 7020 | 161.487 |
| 375 | GACCGCACCTACTCAAACACA | 5354 | DRTYSNT | 7021 | 161.475 |
| 376 | TACTCCGGAGAACTAAACAAA | 5355 | YSGELNK | 7022 | 161.125 |
| 377 | TATGATAAGACTTTGAGTGTT | 5356 | YDKTLSV | 7023 | 160.90695 |
| 378 | CACACCGCCACCCTTAGCAGC | 5357 | HTATLSS | 7024 | 160.8605 |
| 379 | GCTCTGGAGAGGGCTCAGTAT | 5358 | ALERAQY | 7025 | 160.837 |
| 380 | GGTACGAGTGATAATTATAGG | 5359 | GTSDNYR | 7026 | 160.175 |
| 381 | CATGTGAATAGTAGGGATCTT | 5360 | HVNSRDL | 7027 | 160.127 |
| 382 | TCGTCAGACGTTACCAGACAA | 5361 | SSDVTRQ | 7028 | 160.07 |
| 383 | GCTCATCATATGACGACGGAG | 5362 | AHHMTTE | 7029 | 160.019 |
| 384 | GAGGTGTCTAGGGATGGTCTG | 5363 | EVSRDGL | 7030 | 159.7445 |
| 385 | GTGGGCCGTGACGCAGAAGCT | 5364 | VGRDAEA | 7031 | 159.58 |
| 386 | GCACACCAAAAAGACCTACGC | 5365 | AHQKDLR | 7032 | 159.3139 |
| 387 | AGTGTTCTGAGTAGTTCGACT | 5366 | SVLSSST | 7033 | 159.208 |
| 388 | CTGGGTACGCTGCTTAGTCAG | 5367 | LGTLLSQ | 7034 | 159.04 |
| 389 | TCACAAAAACCAATCGACGAC | 5368 | SQKPIDD | 7035 | 158.663 |
| 390 | GATAATGTGCATGGGCAGGTG | 5369 | DNVHGQV | 7036 | 158.321 |
| 391 | GGTTCGCACAACGGGCCGACA | 5370 | GSHNGPT | 7037 | 157.748 |
| 392 | ATCTCCGGTAGTAGCAGTCTA | 5371 | ISGSSSL | 7038 | 157.64 |
| 393 | GGTTTTCATATTAATGGTGAG | 5372 | GFHINGE | 7039 | 157.326 |
| 394 | ATGAGTGATGGGCATTCGAAG | 5373 | MSDGHSK | 7040 | 157.296 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 395 | ACTGTTGGTGGTAATCATCAT | 5374 | TVGGNHH | 7041 | 156.895 |
| 396 | AATGCTACTCCGCCGAATCAT | 5375 | NATPPNH | 7042 | 156.8609 |
| 397 | ACGGGTATGAATAGTAATAAG | 5376 | TGMNSNK | 7043 | 156.85 |
| 398 | ATCGAAGCCTACTCACGAGAC | 5377 | IEAYSRD | 7044 | 156.774 |
| 399 | CGCGACCGTCAAGACTCGGTA | 5378 | RDRQDSV | 7045 | 156.7165 |
| 400 | CACACGGTTCAAATACGCGAA | 5379 | HTVQIRE | 7046 | 156.6241 |
| 401 | ACTTTGACGCAGACTGGGATG | 5380 | TLTQTGM | 7047 | 156.5735 |
| 402 | ATTAATAATTTTAATACTCTG | 5381 | INNFNTL | 7048 | 156.48 |
| 403 | GTAGCCGCGGGACCAGAAGCG | 5382 | VAAGPEA | 7049 | 156.315 |
| 404 | GATGGTAAGAATAGTTATGCG | 5383 | DGKNSYA | 7050 | 156.294 |
| 405 | TCCAGGCAAGAAAACTTCTCC | 5384 | SRQENFS | 7051 | 156.182 |
| 406 | TCTAACAGCAGTGTTGCGGTA | 5385 | SNSSVAV | 7052 | 156.048 |
| 407 | GATCATAGTAAGCAGAGTTCG | 5386 | DHSKQSS | 7053 | 155.89425 |
| 408 | TTGAGTGGTGCTGGTAGTCAG | 5387 | LSGAGSQ | 7054 | 154.9295 |
| 409 | GGTTGGAGTAATAATGAGTTG | 5388 | GWSNNEL | 7055 | 154.4735 |
| 410 | CTAATACGAGGTTCCATGGAA | 5389 | LIRGSME | 7056 | 154.426 |
| 411 | AATACTTATACTGCTGGTAAG | 5390 | NTYTAGK | 7057 | 154.346 |
| 412 | ACTCGTGGCGACATGGAATTC | 5391 | TRGDMEF | 7058 | 154.246 |
| 413 | CTCATGTCAGGGAAAGAAAAC | 5392 | LMSGKEN | 7059 | 154.155 |
| 414 | AAGGATACTAATCAGCAGATT | 5393 | KDTNQQI | 7060 | 153.7595 |
| 415 | CACAACGTCGGCCTAGGACAC | 5394 | HNVGLGH | 7061 | 153.7 |
| 416 | CCTGATCAGCCTGGTCCTTCT | 5395 | PDQPGPS | 7062 | 153.51 |
| 417 | ATGCAAAGAGAAGCAGCCAAC | 5396 | MQREAAN | 7063 | 153.45 |
| 418 | GGGCAGCGTACGACGAATGAT | 5397 | GQRTTND | 7064 | 153.425 |
| 419 | AAACACACAGAAAACGGGACC | 5398 | KHTENGT | 7065 | 153.394 |
| 420 | TTAGACGTGACGAGAATGAGA | 5399 | LDVTRMR | 7066 | 153.086 |
| 421 | ACGTTGGATCGGAATCAGACT | 5400 | TLDRNQT | 7067 | 152.9552 |
| 422 | ATCAACGCCGGCAACTACCGA | 5401 | INAGNYR | 7068 | 152.8475 |
| 423 | GCCGTAGACCAATCACGTTTG | 5402 | AVDQSRL | 7069 | 152.8359 |
| 424 | GCTCTTGGGCATCAGGGGAAT | 5403 | ALGHQGN | 7070 | 152.467 |
| 425 | CTTCCGCGTCATGATCAGTAT | 5404 | LPRHDQY | 7071 | 152.412 |
| 426 | ATTTCTGGGTCGTCGTCTCTT | 5405 | ISGSSSL | 7072 | 152.2375 |
| 427 | TGGAATACGAATATGGCGATT | 5406 | WNTNMAI | 7073 | 151.8755 |
| 428 | ATGTCGGATCGTACTTCTGAT | 5407 | MSDRTSD | 7074 | 151.677 |
| 429 | ACAAGGGAATCAATGTCCATC | 5408 | TRESMSI | 7075 | 151.6105 |
| 430 | CAGCGGGGGGAGCTTCCTGCG | 5409 | QRGELPA | 7076 | 151.533 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 431 | TCGTCTGATCCTAAGGGGCAG | 5410 | SSDPKGQ | 7077 | 151.4265 |
| 432 | CCGAGTGATAGGACTACTTAT | 5411 | PSDRTTY | 7078 | 151.3695 |
| 433 | TCTTCTTCTGATAGTCCGCGT | 5412 | SSSDSPR | 7079 | 151.2845 |
| 434 | GTATTACACTCTGTATCAGCA | 5413 | VLHSVSA | 7080 | 151.217 |
| 435 | AGTATGCAATCATACACCATG | 5414 | SMQSYTM | 7081 | 151.1285 |
| 436 | TCTCTGCAACTCACAGCGGGT | 5415 | SLQLTAG | 7082 | 151.106 |
| 437 | AACAACGTAAACCCGTACTCG | 5416 | NNVNPYS | 7083 | 151.0935 |
| 438 | CTTGCGAATGGTATGACGGCT | 5417 | LANGMTA | 7084 | 150.9825 |
| 439 | GGAATCACAGGATCAACAGGA | 5418 | GITGSTG | 7085 | 150.979 |
| 440 | ATGCTTGTTCAGAATACTCCT | 5419 | MLVQNTP | 7086 | 150.943 |
| 441 | GATGCGAATGCGGGTACGAGG | 5420 | DANAGTR | 7087 | 150.871 |
| 442 | GAAACCGGAGCTATGACCTCT | 5421 | ETGAMTS | 7088 | 150.803 |
| 443 | ATACAAACTACTACAAAATGC | 5422 | IQTTTKC | 7089 | 150.692 |
| 444 | GCGCAGCAGAGTCTTCATGGT | 5423 | AQQSLHG | 7090 | 150.673 |
| 445 | ATTGATAGTACTTGGAATACG | 5424 | IDSTWNT | 7091 | 150.518 |
| 446 | ACCGAATCGCAAACCATGAGG | 5425 | TESQTMR | 7092 | 150.4394 |
| 447 | TTGATCCAAACGCAAGGCACG | 5426 | LIQTQGT | 7093 | 150.329 |
| 448 | ATAGTAAACATAACTCAATCG | 5427 | IVNITQS | 7094 | 150.305 |
| 449 | GTGGCGGTGTCTAATACGCCT | 5428 | VAVSNTP | 7095 | 150.03285 |
| 450 | GGTCATAGGGATTCGGGTGGT | 5429 | GHRDSGG | 7096 | 149.991 |
| 451 | CGGAATGAGAATCTTAATAAT | 5430 | RNENLNN | 7097 | 149.913 |
| 452 | GTCATGCAACGATCTGCACAA | 5431 | VMQRSAQ | 7098 | 149.77 |
| 453 | GTCTCGGGTCCGGTATCGGTC | 5432 | VSGPVSV | 7099 | 149.7645 |
| 454 | GGGGATATTCAGAGTCATAGT | 5433 | GDIQSHS | 7100 | 149.392 |
| 455 | GTTGAGAAGCCTCTGGAGACT | 5434 | VEKPLET | 7101 | 149.24 |
| 456 | GGTGTTCAGATGACTGCGGGG | 5435 | GVQMTAG | 7102 | 149.14805 |
| 457 | ACCACAAAAACGACATCTATG | 5436 | TTKTTSM | 7103 | 149.0935 |
| 458 | CCTGGGAATCCGTCTAGTAAT | 5437 | PGNPSSN | 7104 | 148.9075 |
| 459 | GCTTCGCGGCCTGCGGCTCAG | 5438 | ASRPAAQ | 7105 | 148.8831 |
| 460 | GTTCATGATCAGGGGCTGGG | 5439 | VHDQGAG | 7106 | 148.829 |
| 461 | TCAGGTTCGGAATACCGTACC | 5440 | SGSEYRT | 7107 | 148.812 |
| 462 | TACGTGGACGACAACAGTCGC | 5441 | YVDDNSR | 7108 | 148.744 |
| 463 | ATGGCCGGTGACCAAGAACTC | 5442 | MAGDQEL | 7109 | 148.7 |
| 464 | CCTTTGCACAACATACCTCCT | 5443 | PLHNIPP | 7110 | 148.609 |
| 465 | AGTGGGATTGGTACTTATTCT | 5444 | SGIGTYS | 7111 | 148.357 |
| 466 | TCGAACGCAGACATCCTCGCC | 5445 | SNADILA | 7112 | 148.08 |
| 467 | AGTCACAACCAAGTAAACGTA | 5446 | SHNQVNV | 7113 | 147.981 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 468 | CAGCATTCTCCGAAGCCGGTT | 5447 | QHSPKPV | 7114 | 147.97 |
| 469 | TCCGCAAACAACATAGCCCCC | 5448 | SANNIAP | 7115 | 147.813 |
| 470 | GAAGAAACACGGACCAGAATG | 5449 | EETRTRM | 7116 | 147.667 |
| 471 | CTGTCTAATTCGATTACGCCT | 5450 | LSNSITP | 7117 | 147.594 |
| 472 | AGTGCTTTGAATAGTGTGGAT | 5451 | SALNSVD | 7118 | 147.326 |
| 473 | ACTAATCTTGCTGTTACGCTG | 5452 | TNLAVTL | 7119 | 147.1589 |
| 474 | CAGTCGACGCTGAATAGGCCT | 5453 | QSTLNRP | 7120 | 147.0302 |
| 475 | ATAGAACACATGCTTAGACCC | 5454 | IEHMLRP | 7121 | 146.9635 |
| 476 | CCGACTCCTAATGAGCATATG | 5455 | PTPNEHM | 7122 | 146.84 |
| 477 | ATTAATGAGATTGGTAGGATG | 5456 | INEIGRM | 7123 | 146.786 |
| 478 | AACAACGACAACGTCTACGTG | 5457 | NNDNVYV | 7124 | 146.764 |
| 479 | ATAGTCCACACCCCGCAAGTG | 5458 | IVHTPQV | 7125 | 146.309 |
| 480 | CATAAGAGTGAGAGTCATAAT | 5459 | HKSESHN | 7126 | 146.142 |
| 481 | TCATCGTCAGACTCACCCAGA | 5460 | SSSDSPR | 7127 | 146.067 |
| 482 | TACTCTACAGAAGCACGAGTC | 5461 | YSTEARV | 7128 | 145.9845 |
| 483 | ACCTCGGGTGACCGGTACACG | 5462 | TSGDRYT | 7129 | 145.963 |
| 484 | GAGAAGAATCTGACTAATGCT | 5463 | EKNLTNA | 7130 | 145.88775 |
| 485 | ACAAGGGACCAAAGGTCTACA | 5464 | TRDQRST | 7131 | 145.8855 |
| 486 | GCGACTGATAAGATGACTCCT | 5465 | ATDKMTP | 7132 | 145.881 |
| 487 | AATAGTTATACTGCTGGGAAG | 5466 | NSYTAGK | 7133 | 145.87565 |
| 488 | ACGCTGGATACTAAGGATCTT | 5467 | TLDTKDL | 7134 | 145.82 |
| 489 | GCATCCAACGGGCAAGTTAAC | 5468 | ASNGQVN | 7135 | 145.7395 |
| 490 | ACCTCAATATCGTCGCAAAGC | 5469 | TSISSQS | 7136 | 145.707 |
| 491 | GATAATAGTCCTGCTAATCAT | 5470 | DNSPANH | 7137 | 145.5712 |
| 492 | AACTCCAGGGAAATGGGTGTA | 5471 | NSREMGV | 7138 | 145.562 |
| 493 | ACCAGCGCGTCTGAAAACTGG | 5472 | TSASENW | 7139 | 145.56 |
| 494 | ACTGTAGGATCCTCATACGCT | 5473 | TVGSSYA | 7140 | 145.0453 |
| 495 | CAACAATCACAAAACTCTATA | 5474 | QQSQNSI | 7141 | 144.9825 |
| 496 | CTTCGGGATGGGATTGCTTCT | 5475 | LRDGIAS | 7142 | 144.9725 |
| 497 | GTGCAAAAAACGACGGCTTGG | 5476 | VQKTTAW | 7143 | 144.78 |
| 498 | ATGAGTACGGTTCTTCGGGAG | 5477 | MSTVLRE | 7144 | 144.5125 |
| 499 | AGTATGGATGCTCGGTTGACG | 5478 | SMDARLT | 7145 | 144.404 |
| 500 | GGCGCCCGTACAATCTTAGAC | 5479 | GARTILD | 7146 | 144.3975 |
| 501 | CACGAAAGCCACTACGTGTCA | 5480 | HESHYVS | 7147 | 144.2755 |
| 502 | CTTGAGGGTCAGAATAAGACG | 5481 | LEGQNKT | 7148 | 144.137 |
| 503 | CGGGACTTGAGACCCGTGACG | 5482 | RDLRPVT | 7149 | 143.788 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 504 | CAGATTTTGAATTATAGTGTG | 5483 | QILNYSV | 7150 | 143.741 |
| 505 | ATAAGTGTAGGTGTGTCCGTA | 5484 | ISVGVSV | 7151 | 143.727 |
| 506 | AAGGCGGGTGAGTATAGGGAT | 5485 | KAGEYRD | 7152 | 143.693 |
| 507 | CTTACTACGAATGGTATGCTG | 5486 | LTTNGML | 7153 | 143.66 |
| 508 | ACTAGTAATTATATGCATGAG | 5487 | TSNYMHE | 7154 | 143.642 |
| 509 | ACCCACAACTCTACAGGCCTT | 5488 | THNSTGL | 7155 | 143.502 |
| 510 | AATAATGTTGTTAGGGATGAT | 5489 | NNVVRDD | 7156 | 143.142 |
| 511 | AGTGGGACGTATGCTAGTCGT | 5490 | SGTYASR | 7157 | 143.123 |
| 512 | CTGTCTCACGCCATGGACCGG | 5491 | LSHAMDR | 7158 | 142.937 |
| 513 | AATTGGAATTCTGAGGGTACG | 5492 | NWNSEGT | 7159 | 142.7425 |
| 514 | AGTCTGCGTCCAACCCTACCT | 5493 | SLRPTLP | 7160 | 142.4292 |
| 515 | TACCAAACGGGAGACAAAGAC | 5494 | YQTGDKD | 7161 | 142.104 |
| 516 | CGCAGCGACAAAGGAACGTTG | 5495 | RSDKGTL | 7162 | 142.1004 |
| 517 | TCTACCATCGGCAACAGCACG | 5496 | STIGNST | 7163 | 142.0895 |
| 518 | GAAAACAACATGCAACACGGC | 5497 | ENNMQHG | 7164 | 142.037 |
| 519 | AAGTATACGGAGTCGAATGCG | 5498 | KYTESNA | 7165 | 142.0295 |
| 520 | CCAACAAACAACTTAAGTATG | 5499 | PTNNLSM | 7166 | 141.91 |
| 521 | TGCAAAAACAACTCAGAATGC | 5500 | CKNNSEC | 7167 | 141.874 |
| 522 | ACGGTTAATGCGGATGGGTCG | 5501 | TVNADGS | 7168 | 141.672 |
| 523 | TTTTCTGGTCAGGCGTTGGCT | 5502 | FSGQALA | 7169 | 141.6645 |
| 524 | AATCATATTAGGAATCCTATG | 5503 | NHIRNPM | 7170 | 141.628 |
| 525 | ATGGTGAATTCGGAGAATACT | 5504 | MVNSENT | 7171 | 141.624 |
| 526 | ACTGATGGGCCGCGTCTGGCT | 5505 | TDGPRLA | 7172 | 141.5814 |
| 527 | TTCAACGGGTACGTCATGGCA | 5506 | FNGYVMA | 7173 | 141.042 |
| 528 | AATGCGAATGGGCCTGTGAGT | 5507 | NANGPVS | 7174 | 141.0385 |
| 529 | AGTACGAGTCAGGAGAATAGG | 5508 | STSQENR | 7175 | 140.9233 |
| 530 | CAAGGGACTCTCTTGTCTCCA | 5509 | QGTLLSP | 7176 | 140.773 |
| 531 | CTAATCACAGCCACCACTAAC | 5510 | LITATTN | 7177 | 140.4315 |
| 532 | TCTGGCGTCTCGAAAGAACGG | 5511 | SGVSKER | 7178 | 140.3655 |
| 533 | TCTACTTCAATAGGAGTGGTA | 5512 | STSIGVV | 7179 | 140.351 |
| 534 | TCTCATGTGACTGTTACGGAT | 5513 | SHVTVTD | 7180 | 140.31 |
| 535 | TCTAATAATCTGAATCAGGAG | 5514 | SNNLNQE | 7181 | 140.282 |
| 536 | GCAAACCACGACAACATCGTG | 5515 | ANHDNIV | 7182 | 140.0405 |
| 537 | GACACGTCCTCCGGCAACAGG | 5516 | DTSSGNR | 7183 | 140.01 |
| 538 | GTGGTTCCTATGCCTACTACT | 5517 | VVPMPTT | 7184 | 139.945 |
| 539 | CTTACTAATAATTTTAAGGAT | 5518 | LTNNFKD | 7185 | 139.782 |
| 540 | TCTTCGCCTACTAAGGGTACT | 5519 | SSPTKGT | 7186 | 139.7594 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
| --- | --- | --- | --- | --- | --- |
| 541 | GATATTCCGTCTGATAATACG | 5520 | DIPSDNT | 7187 | 139.44 |
| 542 | TACACGGGATTCGAATTGAGA | 5521 | YTGFELR | 7188 | 139.43 |
| 543 | AACTCAGGTAACAACCCCATC | 5522 | NSGNNPI | 7189 | 139.4185 |
| 544 | ACGACCCGAAACGAACACTCG | 5523 | TTRNEHS | 7190 | 139.3175 |
| 545 | AATGTGGGTAATACTCTTGGG | 5524 | NVGNTLG | 7191 | 139.128 |
| 546 | TACCACACCCACCAAGTCGCA | 5525 | YHTHQVA | 7192 | 138.871 |
| 547 | GGTAGTGCGAGTAATAGTGGT | 5526 | GSASNSG | 7193 | 138.841 |
| 548 | GGGAAGAATCAGCCTACTCCG | 5527 | GKNQPTP | 7194 | 138.839 |
| 549 | TTCACCGCCACTTTAGGAACC | 5528 | FTATLGT | 7195 | 138.809 |
| 550 | ATGAACCAAATGGGCGGCCTG | 5529 | MNQMGGL | 7196 | 138.794 |
| 551 | AACGTGTCACTAACGCAAACG | 5530 | NVSLTQT | 7197 | 138.62365 |
| 552 | TCGTCTAGCAACACAAACGCT | 5531 | SSSNTNA | 7198 | 138.538 |
| 553 | ACTAATTCTAATCAGAGTTCG | 5532 | TNSNQSS | 7199 | 138.513 |
| 554 | ATAAGTCACGACCTTAAATAC | 5533 | ISHDLKY | 7200 | 138.4685 |
| 555 | GATTCGACGTATGTTTTGGCT | 5534 | DSTYVLA | 7201 | 138.402 |
| 556 | ATGAACACCGGCTCTTCGAGT | 5535 | MNTGSSS | 7202 | 138.35 |
| 557 | GCCGGAAACTACCAATCATCA | 5536 | AGNYQSS | 7203 | 138.2335 |
| 558 | ACGATTTATAATATGGGTCCG | 5537 | TIYNMGP | 7204 | 138.1385 |
| 559 | GTATCAACGACAACGGACCGG | 5538 | VSTTTDR | 7205 | 137.9925 |
| 560 | GGGGTGACTGTTAGGGAGCTT | 5539 | GVTVREL | 7206 | 137.96205 |
| 561 | GATATTACTAATCAGTCGTAT | 5540 | DITNQSY | 7207 | 137.802 |
| 562 | AATCAGTCGCTTACTATGGAT | 5541 | NQSLTMD | 7208 | 137.363 |
| 563 | ACGAATTATAATATTGGTCCG | 5542 | TNYNIGP | 7209 | 137.0645 |
| 564 | CGTGGTACGGAGGGGACGCCG | 5543 | RGTEGTP | 7210 | 137.0621 |
| 565 | CCCATAACACGGGAATCGGGA | 5544 | PITRESG | 7211 | 136.943 |
| 566 | ACCGGACAAGCGGGCGGATCG | 5545 | TGQAGGS | 7212 | 136.857 |
| 567 | ATGACTAAACACGACGCGACG | 5546 | MTKHDAT | 7213 | 136.624 |
| 568 | CCTATACCCCACGGTTCATCC | 5547 | PIPHGSS | 7214 | 136.299 |
| 569 | ACGACTGGGGGACGGGGATG | 5548 | TTGGTGM | 7215 | 136.1295 |
| 570 | CTAACCGAATCTGTGAGAAAC | 5549 | LTESVRN | 7216 | 135.933 |
| 571 | AGTAGTAATCTGACTTTGTCT | 5550 | SSNLTLS | 7217 | 135.86 |
| 572 | TTGAATAATTCTGCGACTGTT | 5551 | LNNSATV | 7218 | 135.76 |
| 573 | GCATACGGATCGTCCGGAAGA | 5552 | AYGSSGR | 7219 | 135.5095 |
| 574 | GTTTCTTATGATAATGGGTCG | 5553 | VSYDNGS | 7220 | 135.48 |
| 575 | CCGAGTCAGAGTAGGTCGCTT | 5554 | PSQSRSL | 7221 | 135.38455 |
| 576 | GTCCTGGTTAACGTACACAAC | 5555 | VLVNVHN | 7222 | 135.346 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 577 | TTGATGACTGGTACTGCGTCG | 5556 | LMTGTAS | 7223 | 135.327 |
| 578 | GCTGCTGGTAATCCTACTCGT | 5557 | AAGNPTR | 7224 | 135.3067 |
| 579 | TCCGCGCAATCTTTCGTAGTT | 5558 | SAQSFVV | 7225 | 134.721 |
| 580 | CAAGACCAAACGAGCAACCGT | 5559 | QDQTSNR | 7226 | 134.721 |
| 581 | CAGTCGATTGGGCATCCGGTG | 5560 | QSIGHPV | 7227 | 134.625 |
| 582 | GCTGGGGTGCGTGAGTCGTTT | 5561 | AGVRESF | 7228 | 134.586 |
| 583 | AATACTAATTATGCGATGCAT | 5562 | NTNYAMH | 7229 | 134.493 |
| 584 | GAGCGGAGTACGCATAATGTT | 5563 | ERSTHNV | 7230 | 134.479 |
| 585 | ATGTCCGGATCCATGATATCA | 5564 | MSGSMIS | 7231 | 134.414 |
| 586 | TCTGGCCAAGGATTCTCGGCA | 5565 | SGQGFSA | 7232 | 134.3465 |
| 587 | ACATTCACTACTCTGGGCAAA | 5566 | TFTTLGK | 7233 | 134.2015 |
| 588 | GACGCAAACGCTGGCACAAGA | 5567 | DANAGTR | 7234 | 134.063 |
| 589 | AGGGATACGGCTAAGGGGGTG | 5568 | RDTAKGV | 7235 | 133.882 |
| 590 | GTGCGGTCTGGTAATAAGCCG | 5569 | VRSGNKP | 7236 | 133.87 |
| 591 | CCCCAATGGGGAACTGACCCG | 5570 | PQWGTDP | 7237 | 133.743 |
| 592 | GCCTTCCAAAACACCGGCGCA | 5571 | AFQNTGA | 7238 | 133.743 |
| 593 | GCGACGACTCAGCTGATGACT | 5572 | ATTQLMT | 7239 | 133.675 |
| 594 | ACGAACGCGAGCGAAGGCTCA | 5573 | TNASEGS | 7240 | 133.642 |
| 595 | ATGCTCACAGAAACCAAAGCA | 5574 | MLTETKA | 7241 | 133.57 |
| 596 | ACGAATAATTTGCTGGCTCAG | 5575 | TNNLLAQ | 7242 | 133.517 |
| 597 | GATGTTTTGCTTAAGAATTTT | 5576 | DVLLKNF | 7243 | 133.49 |
| 598 | TATACGCCTGGGCTTACTGAG | 5577 | YTPGLTE | 7244 | 133.356 |
| 599 | CGGCATGCTTCGGATGCTAAT | 5578 | RHASDAN | 7245 | 133.22 |
| 600 | AGTAAGGGTGATCAGCTTAAT | 5579 | SKGDQLN | 7246 | 133.1865 |
| 601 | GTGCTGGTTACTCAGAATCAT | 5580 | VLVTQNH | 7247 | 133.0645 |
| 602 | CGACAAGGCGACTTAAAAGAA | 5581 | RQGDLKE | 7248 | 132.97895 |
| 603 | ATTCAGTCGCAGTCGCAGTTG | 5582 | IQSQSQL | 7249 | 132.832 |
| 604 | AAAATAGAAAGCGGAACCATA | 5583 | KIESGTI | 7250 | 132.825 |
| 605 | ACAACTCTTAGCCAACAAAGC | 5584 | TTLSQQS | 7251 | 132.567 |
| 606 | TTTCAGTTGGCTAGTAATCCG | 5585 | FQLASNP | 7252 | 132.4465 |
| 607 | TGGATTTCTACTGAGATGAGG | 5586 | WISTEMR | 7253 | 132.356 |
| 608 | GCCATAACAATCACTCAAAAA | 5587 | AITITQK | 7254 | 132.1895 |
| 609 | GTTACTGGTGTTGATTATGCG | 5588 | VTGVDYA | 7255 | 131.7275 |
| 610 | ATAATAGCATCCTCTACCACG | 5589 | IIASSTT | 7256 | 131.506 |
| 611 | ATTTATACGAATAGTCATGTT | 5590 | IYTNSHV | 7257 | 131.43 |
| 612 | AACGACATCCCCACACGAGCC | 5591 | NDIPTRA | 7258 | 131.424 |
| 613 | GGCGTAACCAACGCTTCCAAA | 5592 | GVTNASK | 7259 | 131.404 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 614 | AGGGGTAACACTCTCGAAATG | 5593 | RGNTLEM | 7260 | 131.381 |
| 615 | GGTATTAATCATGTGGCGTCT | 5594 | GINHVAS | 7261 | 131.36 |
| 616 | TTCAACGAAACTGCCGGGCGA | 5595 | FNETAGR | 7262 | 131.2915 |
| 617 | GCCTCGCAATCAGAAAAAAAC | 5596 | ASQSEKN | 7263 | 131.243 |
| 618 | GAACTTAACGAAAGGAACCTC | 5597 | ELNERNL | 7264 | 131.06 |
| 619 | GGAGAACAAAGCCACAACCAA | 5598 | GEQSHNQ | 7265 | 130.951 |
| 620 | TTGACTAATGATAATAAGTTG | 5599 | LTNDNKL | 7266 | 130.846 |
| 621 | TCTTATGGGCAGGGTCTGGAG | 5600 | SYGQGLE | 7267 | 130.8108 |
| 622 | CACAGTGACATGGGCTCAAGC | 5601 | HSDMGSS | 7268 | 130.758 |
| 623 | GCGTTAAAATCCGACAGCGCC | 5602 | ALKSDSA | 7269 | 130.684 |
| 624 | ACGAATCTTTCTCCTAAGACG | 5603 | TNLSPKT | 7270 | 130.64725 |
| 625 | GCTGATACGAATATTATTGTG | 5604 | ADTNIIV | 7271 | 130.47 |
| 626 | AGTGAGGGTAGTTCGCGGTCG | 5605 | SEGSSRS | 7272 | 130.30865 |
| 627 | AACTCTAGTAACACTGGTTGG | 5606 | NSSNTGW | 7273 | 130.26 |
| 628 | GTAACGAACGAATCCCGCGCC | 5607 | VTNESRA | 7274 | 130.2145 |
| 629 | GGGCGGCACACATTAGCGGAC | 5608 | GRHTLAD | 7275 | 130.1035 |
| 630 | GCTGTTGTGAATGTTGCGCAG | 5609 | AVVNVAQ | 7276 | 130.094 |
| 631 | AAAAAACCACAACAGTGACTA | 5610 | KKPQQ*L | 7277 | 130.08 |
| 632 | GGCAACGCTTCCGGAAACCCA | 5611 | GNASGNP | 7278 | 129.97 |
| 633 | TTTGCGGCTGGGGCGCATGGT | 5612 | FAAGAHG | 7279 | 129.69 |
| 634 | GGAGGAAACCAAAACCTTACT | 5613 | GGNQNLT | 7280 | 129.6198 |
| 635 | CATACGCAGTCGACGGGTTAT | 5614 | HTQSTGY | 7281 | 129.541 |
| 636 | CTATTGGGAAACGCACCCACA | 5615 | LLGNAPT | 7282 | 129.534 |
| 637 | GAGAAGGGGAATAGTGGGGTT | 5616 | EKGNSGV | 7283 | 129.5155 |
| 638 | GGCACGGAACCGCGCACTGCA | 5617 | GTEPRTA | 7284 | 129.37 |
| 639 | ATGCATGCGCAGGAGTCTCGT | 5618 | MHAQESR | 7285 | 129.14615 |
| 640 | CTGATTTCGACTGGTAATAAT | 5619 | LISTGNN | 7286 | 129.021 |
| 641 | AAGAATAATAATTCTGATTCT | 5620 | KNNNSDS | 7287 | 128.767 |
| 642 | GGGACATTAGCCTCAATGTCC | 5621 | GTLASMS | 7288 | 128.734 |
| 643 | AGGATTGATACGTTGTTGGTG | 5622 | RIDTLLV | 7289 | 128.385 |
| 644 | ATTTCGGGGTCTCATTTGAAT | 5623 | ISGSHLN | 7290 | 128.3305 |
| 645 | ACGGTTGAGGGTTCTTATCCG | 5624 | TVEGSYP | 7291 | 128.288 |
| 646 | ACGGAGTATCTGGCTGGTCTG | 5625 | TEYLAGL | 7292 | 128.224 |
| 647 | TATCTGGAGGGTGCTCATCGT | 5626 | YLEGAHR | 7293 | 128.166 |
| 648 | TTATCCGCAACATCTACGATG | 5627 | LSATSTM | 7294 | 128.1455 |
| 649 | ATGCTTAGTCAGGTTCTGACG | 5628 | MLSQVLT | 7295 | 128.142 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 650 | GCCAGGAACGTAATGCTGGGG | 5629 | ARNVMLG | 7296 | 128.128 |
| 651 | CTTCATGGGAATTTTAGTCAG | 5630 | LHGNFSQ | 7297 | 128.112 |
| 652 | GGCCACGGAAGTGACTTGACC | 5631 | GHGSDLT | 7298 | 128.0576 |
| 653 | GGTGTGAATTATCATACTACG | 5632 | GVNYHTT | 7299 | 127.702 |
| 654 | TATCTGCAGACGGGTACTCTG | 5633 | YLQTGTL | 7300 | 127.624 |
| 655 | GTAAACGGGGAAAACCAGTC | 5634 | VNGGKPV | 7301 | 127.5325 |
| 656 | GAAGTAGGTAAAACCACCCAC | 5635 | EVGKTTH | 7302 | 127.5065 |
| 657 | CGACCCCCGAACGAAAACAGA | 5636 | RPPNENR | 7303 | 127.49235 |
| 658 | GTGGATAAGAATCATCCTTTG | 5637 | VDKNHPL | 7304 | 127.431 |
| 659 | AGTAAGTCGACTGAGATTATG | 5638 | SKSTEIM | 7305 | 127.281 |
| 660 | ACCGCTCTTCTATCTAACTTA | 5639 | TALLSNL | 7306 | 127.228 |
| 661 | ATGCACACAAGTAGACCCCCA | 5640 | MHTSRPP | 7307 | 126.861 |
| 662 | ACTCCAACTAACGGGAACCCT | 5641 | TPTNGNP | 7308 | 126.785 |
| 663 | ACGACGTCTGTGGAGAAGACT | 5642 | TTSVEKT | 7309 | 126.7725 |
| 664 | CAATACGACGCCAGCCGACAA | 5643 | QYDASRQ | 7310 | 126.66 |
| 665 | TACAACGCCCACGAATCATTC | 5644 | YNAHESF | 7311 | 126.521 |
| 666 | GACAACCAACAAGCCCTAGCT | 5645 | DNQQALA | 7312 | 126.49 |
| 667 | ACGAAGAGTTTTAATGATCTT | 5646 | TKSFNDL | 7313 | 126.488 |
| 668 | TTAGCCGACTCAAACAGCAAA | 5647 | LADSNSK | 7314 | 126.48 |
| 669 | CCGAGTACTCATGGGTATGTT | 5648 | PSTHGYV | 7315 | 126.4775 |
| 670 | CAGGTTCAGGGGACTCTGGGG | 5649 | QVQGTLG | 7316 | 126.4394 |
| 671 | CTGACTGCTGTTGCGATTAGT | 5650 | LTAVAIS | 7317 | 126.235 |
| 672 | AGGTATGAGAGTACTAGTGCT | 5651 | RYESTSA | 7318 | 126.21 |
| 673 | GCGGATCATAATCATATTGCT | 5652 | ADHNHIA | 7319 | 126.21 |
| 674 | TGGAATGCTGAGAATAGTAAG | 5653 | WNAENSK | 7320 | 126.112 |
| 675 | AACTCTGTCGTAGGGAACATC | 5654 | NSVVGNI | 7321 | 126.111 |
| 676 | TTCGGAGCAACCACCACAGCA | 5655 | FGATTTA | 7322 | 126.048 |
| 677 | GCTTCAGGGTCTGAAATGCCT | 5656 | ASGSEMF | 7323 | 125.971 |
| 678 | GACGGAACAAAAAGCGGAATG | 5657 | DGTKSGM | 7324 | 125.871 |
| 679 | TACACCGCCGACAAAAAACAA | 5658 | YTADKKQ | 7325 | 125.562 |
| 680 | CCGATTGCTGAGAGGCCTTCT | 5659 | PIAERPS | 7326 | 125.558 |
| 681 | AGCAACTCGTACTTACTCAAC | 5660 | SNSYLLN | 7327 | 125.52 |
| 682 | ACGAGAGAATTGACAAAAAAC | 5661 | TRELTKN | 7328 | 125.47 |
| 683 | CTCGGAAACCACTACACACCC | 5662 | LGNHYTP | 7329 | 125.444 |
| 684 | TTGCTCCAATCCATAGTGGTA | 5663 | LLQSIVV | 7330 | 125.441 |
| 685 | ATGATGGCGAATAATATGCAG | 5664 | MMANNMQ | 7331 | 125.38 |
| 686 | GGCGCGGACACCTCGACCCGG | 5665 | GADTSTR | 7332 | 125.369 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 687 | GGGTTCGGGCACGTGCCCGAA | 5666 | GFGHVPE | 7333 | 125.324 |
| 688 | AACGTTATGCACTCTTCCTCC | 5667 | NVMHSSS | 7334 | 125.313 |
| 689 | TCTGCGTCGAAAGTGGAATAC | 5668 | SASKVEY | 7335 | 125.2945 |
| 690 | ATTTCGAGTTATGATGGTAAT | 5669 | ISSYDGN | 7336 | 125.273 |
| 691 | AAAAAAACGAAAACACTAACT | 5670 | KKTKTLT | 7337 | 125.26 |
| 692 | GGTACCATATTACCAAACCAA | 5671 | GTILPNQ | 7338 | 125.236 |
| 693 | TTAAACGTCGTACCAACACAA | 5672 | LNVVPTQ | 7339 | 125.09 |
| 694 | AGTAGTGTTACTTCGAGGGAG | 5673 | SSVTSRE | 7340 | 124.987 |
| 695 | CCCATCAACGTACTCACGACA | 5674 | PINVLTT | 7341 | 124.911 |
| 696 | GGGGATAAGGCGAGTTTGGCG | 5675 | GDKASLA | 7342 | 124.8255 |
| 697 | AGGATGTCGGAGAGTTCTGAT | 5676 | RMSESSD | 7343 | 124.5625 |
| 698 | AATCTTTTGACTTCGTCGCCT | 5677 | NLLTSSP | 7344 | 124.54 |
| 699 | TCGCGGCTATCACAAGACCCC | 5678 | SRLSQDP | 7345 | 124.3495 |
| 700 | TGGTCGAATGCTCAGAGTCCG | 5679 | WSNAQSP | 7346 | 124.231 |
| 701 | GGCAGACACCTTCAATCGGAC | 5680 | GRHLQSD | 7347 | 124.19 |
| 702 | ATGAGTCTCGCCTCCACCCAA | 5681 | MSLASTQ | 7348 | 124.092 |
| 703 | ATGAGTACGGTTCTTCGCGAG | 5682 | MSTVLRE | 7349 | 124.05 |
| 704 | TCTAAATCTGAAAACCTGCAA | 5683 | SKSENLQ | 7350 | 124.043 |
| 705 | TGGACGGAAGGGGGCTCAGGA | 5684 | WTEGGSG | 7351 | 124 |
| 706 | TCGACTACGGTTTGGACTGCT | 5685 | STTVWTA | 7352 | 123.99 |
| 707 | GTTAGTTTGGAGAGTCGGTTG | 5686 | VSLESRL | 7353 | 123.799 |
| 708 | TCTATGTATGGGCAGGCTGGG | 5687 | SMYGQAG | 7354 | 123.777 |
| 709 | ACTAATACGCAGAATAATCCG | 5688 | TNTQNNP | 7355 | 123.702 |
| 710 | GTCGGTGACAGGAACTTGGTC | 5689 | VGDRNLV | 7356 | 123.663 |
| 711 | CTCGCCCACAACTACTTAAGC | 5690 | LAHNYLS | 7357 | 123.6175 |
| 712 | TGGACAGCTAACCAAGGCTTA | 5691 | WTANQGL | 7358 | 123.566 |
| 713 | GTCTTCCGGGAAGGCATCGTG | 5692 | VFREGIV | 7359 | 123.54 |
| 714 | CAGGTGCAGCATGAGAGGGTG | 5693 | QVQHERV | 7360 | 123.5 |
| 715 | CAAATATTAAACTACTCAGTC | 5694 | QILNYSV | 7361 | 123.4 |
| 716 | AGTACGATTGGTAATTCTACT | 5695 | STIGNST | 7362 | 123.3029 |
| 717 | CCTATACACCACGGTTCATCC | 5696 | PIHHGSS | 7363 | 123.09 |
| 718 | ATTGCTACTAATGTGATTTAT | 5697 | IATNVIY | 7364 | 123.055 |
| 719 | CAAGGCGGTACAAACAACCCC | 5698 | QGGTNNP | 7365 | 123.037 |
| 720 | ACCCGTGGCAACGACATATCA | 5699 | TRGNDIS | 7366 | 123.023 |
| 721 | CAAACGCTCATAGTGGGGTCC | 5700 | QTLIVGS | 7367 | 123.007 |
| 722 | CGGGGTCTGCCTGATGTTAAT | 5701 | RGLPDVN | 7368 | 122.952 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 723 | CTTAATGTGAATACGCTTAAT | 5702 | LNVNTLN | 7369 | 122.896 |
| 724 | GGGACAAAAGCTGGCCTGTC | 5703 | GTKSWPV | 7370 | 122.8432 |
| 725 | ACGCATCTTGTGAGTGATTCG | 5704 | THLVSDS | 7371 | 122.78 |
| 726 | TGGACGGGCGCACAACCTTCT | 5705 | WTGAQPS | 7372 | 122.73955 |
| 727 | TCTGCGATGCACACATTAGTC | 5706 | SAMHTLV | 7373 | 122.5735 |
| 728 | TCCCAACACCACACGCCACTG | 5707 | SQHHTPL | 7374 | 122.4691 |
| 729 | GATAATCGGATGGAGGCTACG | 5708 | DNRMEAT | 7375 | 122.416 |
| 730 | TTGGGAGGAACCCTGGGAATA | 5709 | LGGTLGI | 7376 | 122.38 |
| 731 | TTTCATAATGAGTCTTATGGG | 5710 | FHNESYG | 7377 | 122.36 |
| 732 | ATTCGGACTTCTGTGATTAAT | 5711 | IRTSVIN | 7378 | 122.333 |
| 733 | TATAATACTGTTGATCAGCGG | 5712 | YNTVDQR | 7379 | 122.2905 |
| 734 | GCGCACCAAACCGCCGGGCCA | 5713 | AHQTAGP | 7380 | 122.22 |
| 735 | CCTCCGGAAAGTGCCAGGGGC | 5714 | PPESARG | 7381 | 122.2044 |
| 736 | AATAATACTTTGAATATTTTG | 5715 | NNTLNIL | 7382 | 122.18 |
| 737 | GCTAGTTATAGTAGTATGGTG | 5716 | ASYSSMV | 7383 | 122.0975 |
| 738 | TCGGGTCAAAACGGTACATCA | 5717 | SGQNGTS | 7384 | 122.017 |
| 739 | TTGTCTAGTATGAGTACGGAT | 5718 | LSSMSTD | 7385 | 121.935 |
| 740 | GTCGCCTCGATGGTACACAAC | 5719 | VASMVHN | 7386 | 121.8215 |
| 741 | ACGCAATTGTCAGACGGCTGC | 5720 | TQLSDGC | 7387 | 121.81 |
| 742 | GCGATTGTGGATAGGGGGAGT | 5721 | AIVDRGS | 7388 | 121.757 |
| 743 | AACCGTCAAAGGGACTTCGAA | 5722 | NRQRDFE | 7389 | 121.734 |
| 744 | GCACACCAAAAAGACATACGC | 5723 | AHQKDIR | 7390 | 121.7 |
| 745 | TTCACCGAACGCGCACTCCAA | 5724 | FTERALQ | 7391 | 121.6915 |
| 746 | ATGCTGTCTCATGGTGCGCTT | 5725 | MLSHGAL | 7392 | 121.682 |
| 747 | TCCGTAACCAACGGAGCGGAA | 5726 | SVTNGAE | 7393 | 121.549 |
| 748 | ATCACCGCCGCGTCACCGCAA | 5727 | ITAASPQ | 7394 | 121.5325 |
| 749 | CAAAACACGCAACGATACTTG | 5728 | QNTQRYL | 7395 | 121.5036 |
| 750 | ACTGGCCAAGGATTCTCGGCA | 5729 | TGQGFSA | 7396 | 121.45 |
| 751 | AGTTTTGAGAAGAATGGTATT | 5730 | SFEKNGI | 7397 | 121.45 |
| 752 | CTCACGTCCCACTCTGCGGGC | 5731 | LTSHSAG | 7398 | 121.378 |
| 753 | TCTACAATCGGCAACAGCACG | 5732 | STIGNST | 7399 | 121.27 |
| 754 | GGTCTTAGTCGGAATGATGGT | 5733 | GLSRNDG | 7400 | 121.2415 |
| 755 | TCGACGACGCACCCTTCCGAA | 5734 | STTHPSE | 7401 | 121.238 |
| 756 | CCAAGTACGAACGAAAGCCGC | 5735 | PSTNESR | 7402 | 121.099 |
| 757 | GGTACGAAGGATATTCTGATT | 5736 | GTKDILI | 7403 | 121.039 |
| 758 | TCTACTATTAATATGCGTGCG | 5737 | STINMRA | 7404 | 120.929 |
| 759 | TATATTGCTGGGGGGGAGCAG | 5738 | YIAGGEQ | 7405 | 120.9 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 760 | TCCAGCGGCCAACCGCTCGTC | 5739 | SSGQPLV | 7406 | 120.7415 |
| 761 | GACAAACAACAAACCGGACAA | 5740 | DKQQTGQ | 7407 | 120.6775 |
| 762 | GGGCTAGGACAACCCCAACTC | 5741 | GLGQPQL | 7408 | 120.644 |
| 763 | AGTCCGCAGCATGGTGTTATT | 5742 | SPQHGVI | 7409 | 120.6145 |
| 764 | TATAGGGGTAGGGAGGATTGG | 5743 | YRGREDW | 7410 | 120.58 |
| 765 | GCGGGGGGTTTGCTGTCGCGG | 5744 | AGGLLSR | 7411 | 120.552 |
| 766 | CCGATACAACAAGCCTCATTG | 5745 | PIQQASL | 7412 | 120.375 |
| 767 | TGGAGCGCCGGCGAACGGGTG | 5746 | WSAGERV | 7413 | 120.3415 |
| 768 | AGGGGTGATGTTGCTACGACG | 5747 | RGDVATT | 7414 | 120.26 |
| 769 | TTAACGGGACAAAACGAATTC | 5748 | LTGQNEF | 7415 | 120.24 |
| 770 | ACGACGCCGCCTTTTTCTAAT | 5749 | TTPPFSN | 7416 | 120.2205 |
| 771 | ACGAGTATTGGTAGTGCTAAG | 5750 | TSIGSAK | 7417 | 120.195 |
| 772 | AATGTGCAGAATGTGCCTGGG | 5751 | NVQNVPG | 7418 | 120.16215 |
| 773 | TATACGGGTACTCTTGTTGTT | 5752 | YTGTLVV | 7419 | 120.047 |
| 774 | GGAACCCACGCCTCAGCATAC | 5753 | GTHASAY | 7420 | 119.959 |
| 775 | CTGGTTGTTTCGAATAGTCTG | 5754 | LVVSNSL | 7421 | 119.934 |
| 776 | ACGCATCTTGTGAGGGATTCG | 5755 | THLVRDS | 7422 | 119.7893 |
| 777 | AATCATGGTCGTGCTATTGAT | 5756 | NHGRAID | 7423 | 119.776 |
| 778 | CCCAAAACTCTAACTTCGACA | 5757 | PKTLTST | 7424 | 119.754 |
| 779 | TTCGGTATAGGGCACGGAACA | 5758 | FGIGHGT | 7425 | 119.734 |
| 780 | GCGCTTCCGTCTCGTGAGCGG | 5759 | ALPSRER | 7426 | 119.7235 |
| 781 | GCGACTAGGGGTGAGTCGTCT | 5760 | ATRGESS | 7427 | 119.715 |
| 782 | GGGACAACCGAAGTTAACAAA | 5761 | GTTEVNK | 7428 | 119.685 |
| 783 | ACCCACACCCTTGGGGGAACA | 5762 | THTLGGT | 7429 | 119.68 |
| 784 | GAAGCAGTAACAAGTAAATGG | 5763 | EAVTSKW | 7430 | 119.6575 |
| 785 | CACTACGGTAACAAAGACATA | 5764 | HYGNKDI | 7431 | 119.643 |
| 786 | ATTTCTACGCATACGATGACG | 5765 | ISTHTMT | 7432 | 119.64 |
| 787 | GATACGTATAATAGTAATACT | 5766 | DTYNSNT | 7433 | 119.6 |
| 788 | GTTTTTACTGGGCAGACGGAG | 5767 | VFTGQTE | 7434 | 119.544 |
| 789 | TCGGTCACCAGTGGAACACAA | 5768 | SVTSGTQ | 7435 | 119.502 |
| 790 | CATACGTATTCGCAGGCTGAT | 5769 | HTYSQAD | 7436 | 119.47455 |
| 791 | GTAGCGGGCTTAGTCGACATA | 5770 | VAGLVDI | 7437 | 119.41 |
| 792 | GACTCTACCAAAGCCATGCAA | 5771 | DSTKAMQ | 7438 | 119.403 |
| 793 | GAGGGGCATAATCGTGGTATT | 5772 | EGHNRGI | 7439 | 119.354 |
| 794 | GGGTTGCATGGGACGAGTAAT | 5773 | GLHGTSN | 7440 | 119.343 |
| 795 | CCGCTTTCTCTTCATAATAGT | 5774 | PLSHNS | 7441 | 119.312 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 796 | GCGAGTGATAAGGGGGCGAAT | 5775 | ASDKGAN | 7442 | 119.249 |
| 797 | GTGCTGTTGCAGAATTCTCAT | 5776 | VLLQNSH | 7443 | 119.2225 |
| 798 | CTATACGACGGAAAACACGTC | 5777 | LYDGKHV | 7444 | 119.20995 |
| 799 | ACCCAAGGATCTAACACCACA | 5778 | TQGSNTT | 7445 | 119.08 |
| 800 | TTCCTCGACAAATACAACTAC | 5779 | FLDKYNY | 7446 | 119.058 |
| 801 | GACACCGGAATCAAAAACGTT | 5780 | DTGIKNV | 7447 | 119.05 |
| 802 | TCCGGAGCGGCACAAAACCCA | 5781 | SGAAQNP | 7448 | 119.019 |
| 803 | ACCCTCCACACCAAAGACCTA | 5782 | TLHTKDL | 7449 | 118.854 |
| 804 | GCTACTTACGTTGTCGGAACA | 5783 | ATYVVGT | 7450 | 118.84 |
| 805 | CTTGTGGGGACTTTGGTGTAT | 5784 | LVGTLVY | 7451 | 118.809 |
| 806 | TCTAATACGACTGTGCAGCTT | 5785 | SNTTVQL | 7452 | 118.76 |
| 807 | AAGGCTCAGATTAATCAGATG | 5786 | KAQINQM | 7453 | 118.727 |
| 808 | CGGAATGCTACTGTGACTGTT | 5787 | RNATVTV | 7454 | 118.655 |
| 809 | GCAACCAGAGTGGGCAACCAC | 5788 | ATRVGNH | 7455 | 118.599 |
| 810 | AGTTATCAGAATCCTCCGCCT | 5789 | SYQNPPP | 7456 | 118.512 |
| 811 | TTTGATAGTTATAATATTGTG | 5790 | FDSYNIV | 7457 | 118.51 |
| 812 | GCTACTCTTTCTCCGCATGCT | 5791 | ATLSPHA | 7458 | 118.497 |
| 813 | TGGGAGAGTCCGACTAATGCG | 5792 | WESPTNA | 7459 | 118.49 |
| 814 | ATCGAAAACGTAAACCACTTG | 5793 | IENVNHL | 7460 | 118.42 |
| 815 | TATCGGGCTTCGGATGTGGCG | 5794 | YRASDVA | 7461 | 118.372 |
| 816 | CATATGTCTTCTGTTGCGACT | 5795 | HMSSVAT | 7462 | 118.34 |
| 817 | ATCCAAAGAGACGTGGGCCAC | 5796 | IQRDVGH | 7463 | 118.2825 |
| 818 | GAGAGTGTTAGGGAGACTATT | 5797 | ESVRETI | 7464 | 118.25 |
| 819 | CAGGGGGGGAATAGTCGGTTT | 5798 | QGGNSRF | 7465 | 118.236 |
| 820 | GAAAAAGGCACACCAAGTAGC | 5799 | EKGTPSS | 7466 | 118.233 |
| 821 | CACGACAGCACAACCCGCCCA | 5800 | HDSTTRP | 7467 | 118.225 |
| 822 | TTACCAACAGGCGTCCTGCCC | 5801 | LPTGVLP | 7468 | 118.2065 |
| 823 | ACCCTAGGCTACCCAGACAAA | 5802 | TLGYPDK | 7469 | 118.1855 |
| 824 | GCTAACACCGTCACAGAACGA | 5803 | ANTVTER | 7470 | 118.17415 |
| 825 | CACGACAAATCTATCCAACCA | 5804 | HDKSIQP | 7471 | 118.16 |
| 826 | GGAGGAACAGCCCTTGGGAGC | 5805 | GGTALGS | 7472 | 118.123 |
| 827 | GGGGGTAACTACCACACCACT | 5806 | GGNYHTT | 7473 | 118.046 |
| 828 | ATCTCAGAAATGACTAGGTAC | 5807 | ISEMTRY | 7474 | 118.041 |
| 829 | GTTGAATCTAAATCCGAACCA | 5808 | VESKSEP | 7475 | 118.026 |
| 830 | GACCGTGCCCAAAACAACGAA | 5809 | DRAQNNE | 7476 | 118.006 |
| 831 | ACGGCGCAGACCGGCTGGGTT | 5810 | TAQTGWV | 7477 | 117.96 |
| 832 | GGGTTCGGGCACCTGCCCGAA | 5811 | GFGHLPE | 7478 | 117.86 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 833 | CCTATTACGGGTTTTAGTGTT | 5812 | PITGFSV | 7479 | 117.828 |
| 834 | GATAGGACGTATTCGAATACG | 5813 | DRTYSNT | 7480 | 117.7875 |
| 835 | ATGTCAAACGCCTCCTACATA | 5814 | MSNASYI | 7481 | 117.743 |
| 836 | GATAATAGTAGGCCTGAGGTG | 5815 | DNSRPEV | 7482 | 117.658 |
| 837 | TCAAGTTCCCAAACGGTTTTG | 5816 | SSSQTVL | 7483 | 117.655 |
| 838 | AGTAATCTTGATGGTACTATT | 5817 | SNLDGTI | 7484 | 117.643 |
| 839 | AGTAATATGCGTGAGGAGATT | 5818 | SNMREEI | 7485 | 117.629 |
| 840 | AGACTTACAGAACTGGTCATA | 5819 | RLTELVI | 7486 | 117.583 |
| 841 | CAGGTTAGTCTGGTGAAGTTG | 5820 | QVSLVKL | 7487 | 117.558 |
| 842 | GAAATACACACGACCACAGGC | 5821 | EIHTTTG | 7488 | 117.5505 |
| 843 | AGCAGGATAGAAAACAACAAC | 5822 | SRIENNN | 7489 | 117.5425 |
| 844 | GGAACAGGCAAAGAAGTTCGA | 5823 | GTGKEVR | 7490 | 117.521 |
| 845 | TGGCAGGATCATAATAAGGTG | 5824 | WQDHNKV | 7491 | 117.476 |
| 846 | TCGACAAACTCTATAGGCGCC | 5825 | STNSIGA | 7492 | 117.414 |
| 847 | TCCGAATTAATGGTCAGACCC | 5826 | SELMVRP | 7493 | 117.3623 |
| 848 | CCGCTTCAGAATAATAAGACG | 5827 | PLQNNKT | 7494 | 117.2175 |
| 849 | CCTTATGCGAATAGGCTTGAG | 5828 | PYANRLE | 7495 | 117.21145 |
| 850 | GGGACGGTTTCGCTTATTCCT | 5829 | GTVSLIP | 7496 | 117.175 |
| 851 | GATGTTTATCTTAAGAGTCCG | 5830 | DVYLKSP | 7497 | 117.1435 |
| 852 | TTGCCGGATAAGGGGCGGATT | 5831 | LPDKGRI | 7498 | 117.116 |
| 853 | TCGATAACGACCGTAGCGAAC | 5832 | SITTVAN | 7499 | 117.112 |
| 854 | CCGCTTCAATCCCAATCGGGA | 5833 | PLQSQSG | 7500 | 117.1045 |
| 855 | AATAATATGGGTCATGGTCAT | 5834 | NNMGHGH | 7501 | 117.0365 |
| 856 | AGCGGACAAAAAAACTCAGAA | 5835 | SGQKNSE | 7502 | 116.9665 |
| 857 | ACCGAAGCGGGCCGCCCCCAA | 5836 | TEAGRPQ | 7503 | 116.907 |
| 858 | ACCTTACACACGAAAGACTTG | 5837 | TLHTKDL | 7504 | 116.879 |
| 859 | CTTCGAGACCTAAACGGAGGA | 5838 | LRDLNGG | 7505 | 116.8691 |
| 860 | GTTTGTGTTACTACTTGTGCT | 5839 | VCVTTCA | 7506 | 116.861 |
| 861 | GTCACAGCTGCTCAACCCCAA | 5840 | VTAAQPQ | 7507 | 116.79 |
| 862 | GCGACTTTTAGTCATGCTGGT | 5841 | ATFSHAG | 7508 | 116.788 |
| 863 | ACTTATGCGCCTAGGTCGCCT | 5842 | TYAPRSP | 7509 | 116.75715 |
| 864 | ACGTCGGAGATGCGTACTGCT | 5843 | TSEMRTA | 7510 | 116.5885 |
| 865 | TACTCGACAACCATGCTTAAC | 5844 | YSTTMLN | 7511 | 116.584 |
| 866 | TCTTTCACGAACACAAACCCA | 5845 | SFTNTNP | 7512 | 116.5665 |
| 867 | AGTCCTCCTAGTACGTCGGGT | 5846 | SPPSTSG | 7513 | 116.551 |
| 868 | GTGACGACTGTTGATAGTGCT | 5847 | VTTVDSA | 7514 | 116.477 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 869 | GAGGCGCATAATCGTGTTATT | 5848 | EAHNRVI | 7515 | 116.461 |
| 870 | ATGGAGTTGACTTCTACTAGT | 5849 | MELTSTS | 7516 | 116.456 |
| 871 | CATTTGGTTACTAGTGGTATT | 5850 | HLVTSGI | 7517 | 116.45 |
| 872 | CAAACCATCACCTCACAAATG | 5851 | QTITSQM | 7518 | 116.431 |
| 873 | ACTGCGAATAGTACGTATGTG | 5852 | TANSTYV | 7519 | 116.329 |
| 874 | CTTATCCAATTATCGGGTCAA | 5853 | LIQLSGQ | 7520 | 116.317 |
| 875 | TCTTACGTTAGCGTCCCCGCC | 5854 | SYVSVPA | 7521 | 116.3005 |
| 876 | GTGCATGGGAATGCTCCGGCT | 5855 | VHGNAPA | 7522 | 116.2665 |
| 877 | GCCGGAAAAACCCACGCCGAC | 5856 | AGKTHAD | 7523 | 116.228 |
| 878 | ACATTCCACCAAGGGGTCAAA | 5857 | TFHQGVK | 7524 | 116.175 |
| 879 | TTAGGAAACAACCGGCCACTA | 5858 | LGNNRPL | 7525 | 116.17 |
| 880 | CTGCACCTCGTCCGGAGCTTC | 5859 | LHLVRSF | 7526 | 116.08 |
| 881 | TCCTACAGTACTTCAACACCG | 5860 | SYSTSTP | 7527 | 116.036 |
| 882 | ATATCGCAAGGCTCGAGCCTC | 5861 | ISQGSSL | 7528 | 116.025 |
| 883 | CTCCAACTGGCTACATCCCAC | 5862 | LQLATSH | 7529 | 116.0035 |
| 884 | GTGACTCAGCGGTTTGCTGAG | 5863 | VTQRFAE | 7530 | 115.952 |
| 885 | GCTATAGACTCCATCAAAATG | 5864 | AIDSIKM | 7531 | 115.9415 |
| 886 | GACGCACACACTTTCAGCCGG | 5865 | DAHTFSR | 7532 | 115.93 |
| 887 | CGTGGTTCAGACGGAGGATTG | 5866 | RGSDGGL | 7533 | 115.911 |
| 888 | TTAGCACAAGGCACGGACCGG | 5867 | LAQGTDR | 7534 | 115.884 |
| 889 | AAAAACAACAACTCAGACAGT | 5868 | KNNNSDS | 7535 | 115.7595 |
| 890 | GAAAACGAAAACGAGAAAGC | 5869 | ENEKRES | 7536 | 115.741 |
| 891 | AACGAACAATTCGAAAAAGTC | 5870 | NEQFEKV | 7537 | 115.705 |
| 892 | ACACAAGTAGTCGCAAGAACA | 5871 | TQVVART | 7538 | 115.68045 |
| 893 | GGAGTAAACGTCACCAACAGC | 5872 | GVNVTNS | 7539 | 115.64 |
| 894 | GCCGACAAAGGATTCGGCCAC | 5873 | ADKGFGH | 7540 | 115.5886 |
| 895 | ACTCATAAGCAGGTGGATCTT | 5874 | THKQVDL | 7541 | 115.54825 |
| 896 | TCGGCTAACTTATACAAACAA | 5875 | SANLYKQ | 7542 | 115.544 |
| 897 | AAGCTGCATACTAAGGATCTT | 5876 | KLHTKDL | 7543 | 115.54 |
| 898 | GTGGTGGTTCACACTATCCCA | 5877 | VVVHTIP | 7544 | 115.52 |
| 899 | TCTACGTCTCAGGCTGTGCAG | 5878 | STSQAVQ | 7545 | 115.496 |
| 900 | CGTAACGGCTCCGCCCAAAGC | 5879 | RNGSAQS | 7546 | 115.465 |
| 901 | CATTATGGGAATAAGGATATT | 5880 | HYGNKDI | 7547 | 115.402 |
| 902 | AGCTTCTTGGTAGCCCACCCA | 5881 | SFLVAHP | 7548 | 115.4 |
| 903 | CAGCAGAATACAGAGTTTGCCG | 5882 | QQNTSLP | 7549 | 115.39 |
| 904 | ATGCACGTCGACAAAACGAGT | 5883 | MHVDKTS | 7550 | 115.379 |
| 905 | AATAATGAGAATACGCGTAAT | 5884 | NNENTRN | 7551 | 115.363 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 906 | TCGATAAACAACATAGGCGCA | 5885 | SINNIGA | 7552 | 115.3425 |
| 907 | GCTACTATATCGGACCGAGCC | 5886 | ATISDRA | 7553 | 115.327 |
| 908 | TACTCAAACCTCGTACTTTCC | 5887 | YSNLVLS | 7554 | 115.285 |
| 909 | ATGATGAATGTGAGTGGTCAT | 5888 | MMNVSGH | 7555 | 115.2555 |
| 910 | GGGGAGACGCGGTCGACTGCT | 5889 | GETRSTA | 7556 | 115.18 |
| 911 | ACGAAGGGTTATAATGATCTT | 5890 | TKGYNDL | 7557 | 115.1635 |
| 912 | GCGTATAATATGTCGTCTGTT | 5891 | AYNMSSV | 7558 | 115.148 |
| 913 | GCAGACCCCGCTAAAGGCAAA | 5892 | ADPAKGK | 7559 | 115.1435 |
| 914 | TATATTTCGGCGCCTCCGATG | 5893 | YISAPPM | 7560 | 115.1145 |
| 915 | CGAAACAACCCATCGCACGAC | 5894 | RNNPSHD | 7561 | 115.069 |
| 916 | GGAACCTCCATAGACTACGTA | 5895 | GTSIDYV | 7562 | 115.053 |
| 917 | GGCACCGGGTACCCAAACCAA | 5896 | GTGYPNQ | 7563 | 115.038 |
| 918 | GATCATATGAATTTGAGGTCT | 5897 | DHMNLRS | 7564 | 114.9475 |
| 919 | ATTAATTCGTATTTGCATGAG | 5898 | INSYLHE | 7565 | 114.887 |
| 920 | TGGCAAATGGGGGCCGGGAGC | 5899 | WQMGAGS | 7566 | 114.833 |
| 921 | ATGGGTATCGGGTCATACAAA | 5900 | MGIGSYK | 7567 | 114.827 |
| 922 | CAAAACCACAACGAACTAAAA | 5901 | QNHNELK | 7568 | 114.749 |
| 923 | GATAAGTCTAATTATAGTATT | 5902 | DKSNYSI | 7569 | 114.736 |
| 924 | ACAACGAAACCGGTCGCGGAA | 5903 | TTKPVAE | 7570 | 114.7315 |
| 925 | GTGACTGTGAGTAATAGTCTG | 5904 | VTVSNSL | 7571 | 114.685 |
| 926 | ACGGCGTATCTGGATGGTCTG | 5905 | TAYLDGL | 7572 | 114.665 |
| 927 | AATTTGCAGACTGGTGTTCAG | 5906 | NLQTGVQ | 7573 | 114.65 |
| 928 | ACCGTCGCTCCCTACAGTAGC | 5907 | TVAPYSS | 7574 | 114.65 |
| 929 | GTTCAGATTTCTATGAATAAT | 5908 | VQISMNN | 7575 | 114.617 |
| 930 | TACATAGCAGGTGGTGAACAA | 5909 | YIAGGEQ | 7576 | 114.60015 |
| 931 | TTCATGGAAGTCATGAAAAAC | 5910 | FMEVMKN | 7577 | 114.547 |
| 932 | ACGACTGATAAGGGTATTAAT | 5911 | TTDKGIN | 7578 | 114.539 |
| 933 | TTGAGCTACAGCATCCAACAC | 5912 | LSYSIQH | 7579 | 114.53 |
| 934 | GCTTATAATGCTCGTCTGCCT | 5913 | AYNARLP | 7580 | 114.49305 |
| 935 | AACACCGGCACCACGAGTGTC | 5914 | NTGTTSV | 7581 | 114.475 |
| 936 | GTGCTGAGTACGGGGCTGCGG | 5915 | VLSTGLR | 7582 | 114.4165 |
| 937 | AACGACTCCTCGTCAATGTCC | 5916 | NDSSSMS | 7583 | 114.397 |
| 938 | CGCCAAGGCAGCTTGATGATA | 5917 | RQGSLMI | 7584 | 114.37 |
| 939 | ATCAGCACCGCATACATGTTG | 5918 | ISTAYML | 7585 | 114.36 |
| 940 | GGTACTATGAATATTGGTATT | 5919 | GTMNIGI | 7586 | 114.356 |
| 941 | CATAATAATAATTTGCTGAAT | 5920 | HNNNLLN | 7587 | 114.292 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 942 | CATTTTTCGCAGATTACTAAT | 5921 | HFSQITN | 7588 | 114.278 |
| 943 | GACCTGACCAGAGCTGCAATA | 5922 | DLTRAAI | 7589 | 114.256 |
| 944 | GTCGCTATGGGAGGCGGTCCC | 5923 | VAMGGGP | 7590 | 114.1845 |
| 945 | GCCTACGGTATCAGAGAAGTG | 5924 | AYGIREV | 7591 | 114.1465 |
| 946 | ACATCAGACGGTCTACTAAGT | 5925 | TSDGLLS | 7592 | 114.128 |
| 947 | ACGATGGCTACAAACTTAAGT | 5926 | TMATNLS | 7593 | 114.082 |
| 948 | AACAACGGCAACTCATCAAGG | 5927 | NNGNSSR | 7594 | 114.047 |
| 949 | ACGGAGAAGGCGAGTCCTCTG | 5928 | TEKASPL | 7595 | 114.031 |
| 950 | CTCAACCACACAATGCCCCTC | 5929 | LNHTMPL | 7596 | 114.027 |
| 951 | GATACGGCGAGTTATAATAAT | 5930 | DTASYNN | 7597 | 114 |
| 952 | AACATGACCAACGAACGGCTC | 5931 | NMTNERL | 7598 | 113.9675 |
| 953 | GTAGTCTCATCGGGCGGCTGG | 5932 | VVSSGGW | 7599 | 113.966 |
| 954 | GTGAATCAGAGTCCTGGGGCT | 5933 | VNQSPGA | 7600 | 113.85 |
| 955 | GATCATCATCCTCAGAGTCGT | 5934 | DHRPQSR | 7601 | 113.83 |
| 956 | CGATGGCAAGGACTGAGCGCG | 5935 | RWQGLSA | 7602 | 113.76 |
| 957 | GCGGTTACGACAAGCGTGAGG | 5936 | AVTTSVR | 7603 | 113.752 |
| 958 | TGGGGAGTCAGTAACTCAGCA | 5937 | WGVSNSA | 7604 | 113.7505 |
| 959 | GCGCATATGCATTCGGAGTTG | 5938 | AHMHSEL | 7605 | 113.74 |
| 960 | AATAATCTTACGAATTCGACG | 5939 | NNLTNST | 7606 | 113.736 |
| 961 | AGTAGTGGGGGTATGAAGGCG | 5940 | SSGGMKA | 7607 | 113.69 |
| 962 | GTTGGGTATGGGGAGCATGTT | 5941 | VGYGEHV | 7608 | 113.64 |
| 963 | ACCATAGTGTCCACTTCTTAC | 5942 | TIVSTSY | 7609 | 113.628 |
| 964 | CCCACCAGTCACCAAGAACCC | 5943 | PTSHQEP | 7610 | 113.62 |
| 965 | TCTAACCTTCGAAACACAATA | 5944 | SNLRNTI | 7611 | 113.58 |
| 966 | TCAAGACACGACGTCCGAAAC | 5945 | SRHDVRN | 7612 | 113.559 |
| 967 | CAGATGAATATTCATGATAAG | 5946 | QMNIHDK | 7613 | 113.543 |
| 968 | TGGGCTATGAATAATGTGCCG | 5947 | WAMNNVP | 7614 | 113.531 |
| 969 | GCGATGGATGGGTATAGGGTT | 5948 | AMDGYRV | 7615 | 113.462 |
| 970 | AAAGGGGAAACCTCACCGCA | 5949 | KGGNLTA | 7616 | 113.4525 |
| 971 | ATTGGTAAGGATAGTGTTCCG | 5950 | IGKDSVP | 7617 | 113.448 |
| 972 | GTGCAGTTGACGCATAATGGG | 5951 | VQLTHNG | 7618 | 113.43 |
| 973 | GGCCTGAACCAGATCACATCG | 5952 | GLNQITS | 7619 | 113.4 |
| 974 | AGGGGTGATCCTTCTACGCCT | 5953 | RGDPSTP | 7620 | 113.4 |
| 975 | GTTCCCTCCGACCCCCACTGG | 5954 | VPSDPHW | 7621 | 113.35 |
| 976 | ACGTTAAGTTCCCAAGTCACA | 5955 | TLSSQVT | 7622 | 113.327 |
| 977 | AACCAAAGAGTTGAACAAAAA | 5956 | NQRVEQK | 7623 | 113.3075 |
| 978 | GTACTTCCAAGTCGGATCGCG | 5957 | VLPSRIA | 7624 | 113.3 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 979 | GGGCACTACGCTACAAACACA | 5958 | GHYATNT | 7625 | 113.212 |
| 980 | CCTTCGATTCCGTCGTTTTCG | 5959 | PSIPSFS | 7626 | 113.207 |
| 981 | ACTTATGAGTATCCGACTCGG | 5960 | TYEYPTR | 7627 | 113.19 |
| 982 | AAAGACCACATCCTCAGCCTC | 5961 | KDHILSL | 7628 | 113.1795 |
| 983 | GGCACAGGAGGTAACCGAGAA | 5962 | GTGGNRE | 7629 | 113.173 |
| 984 | AAGGGGGATGGTGCTTATGAG | 5963 | KGDGAYE | 7630 | 113.162 |
| 985 | TCTTCTTTCGGAAAAGACAAC | 5964 | SSFGKDN | 7631 | 113.1603 |
| 986 | ACAGTATCGTCATACGTACAA | 5965 | TVSSYVQ | 7632 | 113.0595 |
| 987 | AGGGCTCATGGGGATAATCAG | 5966 | RAHGDNQ | 7633 | 113.036 |
| 988 | TATCATGCTCATAGTAATGAG | 5967 | YHAHSNE | 7634 | 113.03 |
| 989 | GCAAACTTGCCCAGCGGTCAC | 5968 | ANLPSGH | 7635 | 113.03 |
| 990 | GCGAACCTCAACTTGACCAGT | 5969 | ANLNLTS | 7636 | 113.015 |
| 991 | AGGCTTAATGCGGGTGAGCAT | 5970 | RLNAGEH | 7637 | 113.0105 |
| 992 | TATGTTGATTATAGTAAGTCG | 5971 | YVDYSKS | 7638 | 112.9935 |
| 993 | GCTAATTCTGGGTTGCATAAT | 5972 | ANSGLHN | 7639 | 112.9695 |
| 994 | ACGAGTGGTGTGCTTACGCGG | 5973 | TSGVLTR | 7640 | 112.9485 |
| 995 | GGAAAACCAGCACAAGAATTC | 5974 | GKPAQEF | 7641 | 112.933 |
| 996 | GTGGGGACGCATTTGCATTCG | 5975 | VGTHLHS | 7642 | 112.918 |
| 997 | CCGATGAACAAAGACATACTG | 5976 | PMNKDIL | 7643 | 112.9116 |
| 998 | GACGCCCACCACTCAAGCAGC | 5977 | DAHHSSS | 7644 | 112.88 |
| 999 | ACTAACGCCATCTCTCAAACG | 5978 | TNAISQT | 7645 | 112.7997 |
| 1000 | GTTTTGTCTGATAAGGCGTAT | 5979 | VLSDKAY | 7646 | 112.787 |
| 1001 | AACCTACTTGTCGACCAACGT | 5980 | NLLVDQR | 7647 | 112.78 |
| 1002 | ACTGGTCATCCGCCGGCGGCG | 5981 | TGHPPAA | 7648 | 112.7735 |
| 1003 | ATTAGTTCGGGGATTTTGTCG | 5982 | ISSGILS | 7649 | 112.7205 |
| 1004 | AATACGAATTTGTTGGGTTAT | 5983 | NTNLLGY | 7650 | 112.72 |
| 1005 | ACGCTATCGGTTACCCTGGGT | 5984 | TLSVTLG | 7651 | 112.71 |
| 1006 | CATACTGGTGTTCAGACTAAT | 5985 | HTGVQTN | 7652 | 112.704 |
| 1007 | GAGGTTAGTAATAATAATTAT | 5986 | EVSNNNY | 7653 | 112.69 |
| 1008 | CTGGCTAATATTTCGCTGTAT | 5987 | LANISLY | 7654 | 112.69 |
| 1009 | GTGGAGCATGTTGCTCATCAG | 5988 | VEHVAHQ | 7655 | 112.656 |
| 1010 | GTCGACAAAAGCGAAGCCGAC | 5989 | VDKSEAD | 7656 | 112.6 |
| 1011 | GGCTTCGCATTAACTGGCACC | 5990 | GFALTGT | 7657 | 112.564 |
| 1012 | TTGTTGACGGCTCCGCATAGG | 5991 | LLTAPHR | 7658 | 112.53 |
| 1013 | AATGCGGGGGCTCTTATGGGT | 5992 | NAGALMG | 7659 | 112.518 |
| 1014 | AGGACGCAAGCAGGGGACTCA | 5993 | RTQAGDS | 7660 | 112.483 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1015 | AACACACACAGACAAGAATAC | 5994 | NTHRQEY | 7661 | 112.461 |
| 1016 | AACATAGCAGGCGGAGAACAA | 5995 | NIAGGEQ | 7662 | 112.442 |
| 1017 | GAGATTAATAATCGGACTGGT | 5996 | EINNRTG | 7663 | 112.43235 |
| 1018 | ACCGTTAACACAATGTACACG | 5997 | TVNTMYT | 7664 | 112.4 |
| 1019 | CCTATGAATGGTATTCTGTTG | 5998 | PMNGILL | 7665 | 112.388 |
| 1020 | AATCCTAGTTATGATCATCGG | 5999 | NPSYDHR | 7666 | 112.363 |
| 1021 | GCTGTTATTCTGAATCCTGTT | 6000 | AVILNPV | 7667 | 112.36 |
| 1022 | CTGTACGGGGGAGCACACCAA | 6001 | LYGGAHQ | 7668 | 112.3455 |
| 1023 | CAAGTCAACCAACCGAGAATA | 6002 | QVNQPRI | 7669 | 112.33 |
| 1024 | GCTGTTAGAACACCGGCAATG | 6003 | AVRTPAM | 7670 | 112.326 |
| 1025 | AGTTTGACGCCTAATAATCTT | 6004 | SLTPNNL | 7671 | 112.283 |
| 1026 | CTTGGGCAGGTTAATTCTACG | 6005 | LGQVNST | 7672 | 112.205 |
| 1027 | GCTAATTCTGCTACTAATCAG | 6006 | ANSATNQ | 7673 | 112.1605 |
| 1028 | TCCTTGACGGAAAAAGCGCCG | 6007 | SLTEKAP | 7674 | 112.15 |
| 1029 | CAATTCCACGGGACATCTGAA | 6008 | QFHGTSE | 7675 | 112.125 |
| 1030 | AAAAACGGCGCCATAGGAACA | 6009 | KNGAIGT | 7676 | 112.0867 |
| 1031 | GTGCTGGCGTCGACTGAGAAG | 6010 | VLASTEK | 7677 | 112.058 |
| 1032 | AGTAATATGAGTGAGGCGATT | 6011 | SNMSEAI | 7678 | 112.02 |
| 1033 | AACGCTAACGCCGGTGGAAAC | 6012 | NANAGGN | 7679 | 112.0148 |
| 1034 | CACTCTAACACACACTACGAA | 6013 | HSNTHYE | 7680 | 112.005 |
| 1035 | AGTGCTTTGATTAGTGTGGTT | 6014 | SALISVV | 7681 | 111.993 |
| 1036 | GTGGCGACTCATTATAATGAG | 6015 | VATHYNE | 7682 | 111.971 |
| 1037 | AACCAAACGTTACAAGTAGAC | 6016 | NQTLQVD | 7683 | 111.97 |
| 1038 | AAAACACCCTCAGCTTCAGAA | 6017 | KTPSASE | 7684 | 111.957 |
| 1039 | GGTGAATCACGTACAAACATG | 6018 | GESRTNM | 7685 | 111.9393 |
| 1040 | CGGAATGAGCCGGTTAGTACT | 6019 | RNEPVST | 7686 | 111.912 |
| 1041 | GCAACACACGCCATGCGCCCA | 6020 | ATHAMRP | 7687 | 111.9005 |
| 1042 | TGGGAATCCCTCTCCAACGCA | 6021 | WESLSNA | 7688 | 111.885 |
| 1043 | CATAGTCCTCCTACGACTATG | 6022 | HSPPTTM | 7689 | 111.847 |
| 1044 | TCTACCATGAACACGATCACG | 6023 | STMNTIT | 7690 | 111.8162 |
| 1045 | AACATGGAACACACCATGGCG | 6024 | NMEHTMA | 7691 | 111.78965 |
| 1046 | CATAATACGGAGTCTAAGACT | 6025 | HNTESKT | 7692 | 111.778 |
| 1047 | CACAACTTAATGACCCAAATA | 6026 | HNLMTQI | 7693 | 111.77 |
| 1048 | AACCAAAACACCTACGAACTG | 6027 | NQNTYEL | 7694 | 111.756 |
| 1049 | TACGCCACTCTCGACACCATC | 6028 | YATLDTI | 7695 | 111.752 |
| 1050 | GTTCAGTTGGAGAATGCGAAT | 6029 | VQLENAN | 7696 | 111.7215 |
| 1051 | GGGCTCACAGGATACACAATG | 6030 | GLTGYTM | 7697 | 111.71 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1052 | TTAGTACTTGACTCACGGAAC | 6031 | LVLDSRN | 7698 | 111.704 |
| 1053 | ATGTTGGTACAAAACACACCC | 6032 | MLVQNTP | 7699 | 111.702 |
| 1054 | CCTCATAATCAGGAGATGGGT | 6033 | PHNQEMG | 7700 | 111.6865 |
| 1055 | TCGTTGGGGGATGCGATGTTG | 6034 | SLGDAML | 7701 | 111.6776 |
| 1056 | CGCGCCGAAGGGAGCTCTGGC | 6035 | RAEGSSG | 7702 | 111.6645 |
| 1057 | AGTGAGGAGAGGACGCGTGCG | 6036 | SEERTRA | 7703 | 111.616 |
| 1058 | TCTAGTAAGGAGCGTACATCG | 6037 | SSKERTS | 7704 | 111.57 |
| 1059 | CCTGTTGTGAGGGATCGTTCT | 6038 | PVVRDRS | 7705 | 111.5643 |
| 1060 | AGGATGTCTGAGAGTTCGGAT | 6039 | RMSESSD | 7706 | 111.51 |
| 1061 | AACCAATCTATAAGCATGGAC | 6040 | NQSISMD | 7707 | 111.491 |
| 1062 | GTCGCTGTATCGAACACTCCA | 6041 | VAVSNTP | 7708 | 111.482 |
| 1063 | GGAGACATCTCAAGCAGAAAC | 6042 | GDISSRN | 7709 | 111.4603 |
| 1064 | GCTGCCGGAGCCGACTCTCCA | 6043 | AAGADSP | 7710 | 111.429 |
| 1065 | TTCGGCACATCGTACACAACC | 6044 | FGTSYTT | 7711 | 111.401 |
| 1066 | CGTGATACTAATACGGATAAG | 6045 | RDTNTDK | 7712 | 111.336 |
| 1067 | GGGTCTACGCCGGGGGCGAGT | 6046 | GSTPGAS | 7713 | 111.327 |
| 1068 | GGTACTAATCATGATTTTTCG | 6047 | GTNHDFS | 7714 | 111.302 |
| 1069 | AATGAGAGTACGAAGGAGAGT | 6048 | NESTKES | 7715 | 111.2845 |
| 1070 | GTGCATGTGACTAATGTGTTG | 6049 | VHVTNVL | 7716 | 111.2295 |
| 1071 | AGTACTACTAATGTTGCGTAT | 6050 | STTNVAY | 7717 | 111.2015 |
| 1072 | ATTACGTCGTTGAATGGGATG | 6051 | ITSLNGM | 7718 | 111.1615 |
| 1073 | GAAGTACGGGGCAGCGTGCCA | 6052 | EVRGSVP | 7719 | 111.1435 |
| 1074 | GCACTTACCCGTATGCCTAAC | 6053 | ALTRMPN | 7720 | 111.1235 |
| 1075 | CTCAGTGTAGCCGACAGGCCA | 6054 | LSVADRP | 7721 | 111.06 |
| 1076 | GTTTCTACGGCGCAGAGGCAG | 6055 | VSTAQRQ | 7722 | 111.056 |
| 1077 | TTAAACGCAGAATACACCAAC | 6056 | LNAEYTN | 7723 | 111.02 |
| 1078 | AATGAGAAGCCGCAGTCGACG | 6057 | NEKPQST | 7724 | 111.009 |
| 1079 | TTGAATACGCTGATTGATAAG | 6058 | LNTLIDK | 7725 | 111.003 |
| 1080 | GTCACACACACACTGATCGAA | 6059 | VTHTLIE | 7726 | 110.987 |
| 1081 | GAGCAGAAGAAGACTGATCAT | 6060 | EQKKTDH | 7727 | 110.936 |
| 1082 | ACATCAGGCATGTACGACACG | 6061 | TSGMYDT | 7728 | 110.92 |
| 1083 | CCTGACGCAGCGCGTAGCCCG | 6062 | PDAARSP | 7729 | 110.916 |
| 1084 | TTGACGCAGGTTTATCATGAG | 6063 | LTQVYHE | 7730 | 110.91 |
| 1085 | AGAGAAATGAGCAGCCTATCT | 6064 | REMSSLS | 7731 | 110.891 |
| 1086 | ATGCCTTCGAAAGGCGAAGTA | 6065 | MPSKGEV | 7732 | 110.816 |
| 1087 | AATGAGCAGAATACGCCGAGT | 6066 | NEQNTPS | 7733 | 110.79 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1088 | AAAAACTACGCAAGCACCGAC | 6067 | KNYASTD | 7734 | 110.7435 |
| 1089 | TGTATGGATGTTGGTAAGGCG | 6068 | CMDVGKA | 7735 | 110.711 |
| 1090 | GCTCTTCATAATCTGATGAAT | 6069 | ALHNLMN | 7736 | 110.711 |
| 1091 | CCTGACAGAGCGAACGACAAA | 6070 | PDRANDK | 7737 | 110.6835 |
| 1092 | ATTGCTCATGTGTCTACTAAT | 6071 | IAHVSTN | 7738 | 110.6805 |
| 1093 | AACGGTCCGACCGGATCCGCC | 6072 | NGPTGSA | 7739 | 110.6652 |
| 1094 | TCTACTCATCATGCTGATCGT | 6073 | STHHADR | 7740 | 110.629 |
| 1095 | GGTTCGCAGTATGGGCGGCAT | 6074 | GSQYGRH | 7741 | 110.629 |
| 1096 | ACCGGAACGGCTACACTCCCA | 6075 | TGTATLP | 7742 | 110.5825 |
| 1097 | AAAGCCCACGTTGTAGAAATA | 6076 | KAHVVEI | 7743 | 110.5795 |
| 1098 | ACTTCGCAGGGTAGGAGTCCT | 6077 | TSQGRSP | 7744 | 110.511 |
| 1099 | TTATCCTCCGAATCACCCAGG | 6078 | LSSESPR | 7745 | 110.5015 |
| 1100 | ACCGGGGTTCGAGAAACCATA | 6079 | TGVRETI | 7746 | 110.4575 |
| 1101 | ATGGATACTGAGCTTTATAGG | 6080 | MDTELYR | 7747 | 110.4475 |
| 1102 | ACACCTGAAGCGAGCGCTCGC | 6081 | TPEASAR | 7748 | 110.44 |
| 1103 | CACGACTTGAACCACGGAAAA | 6082 | HDLNHGK | 7749 | 110.428 |
| 1104 | CTTACTGGTCAGAATGCGATT | 6083 | LTGQNAI | 7750 | 110.416 |
| 1105 | ACCGTCGGATCGAACAGTATA | 6084 | TVGSNSI | 7751 | 110.411 |
| 1106 | CATACTGTGGGGCTATGCAT | 6085 | HTVGAMH | 7752 | 110.41 |
| 1107 | GAACGAGTCAACGGGATGGCA | 6086 | ERVNGMA | 7753 | 110.405 |
| 1108 | TCCGAACCCCTTAGAGTTGGA | 6087 | SEPLRVG | 7754 | 110.3725 |
| 1109 | GTCTCTAACGTCCTCTACAGC | 6088 | VSNVLYS | 7755 | 110.346 |
| 1110 | TTCTCCTCCGGAACAACCATA | 6089 | FSSGTTI | 7756 | 110.3 |
| 1111 | ACAAACCTAAGTCAATCGGCC | 6090 | TNLSQSA | 7757 | 110.24435 |
| 1112 | CCTAATACTGCTAGTAATTTT | 6091 | PNTASNF | 7758 | 110.2274 |
| 1113 | TGCGGCCTGAACTGCGGTAAA | 6092 | CGLNCGK | 7759 | 110.211 |
| 1114 | CCGACCGGAGGCTCACCACCA | 6093 | PTGGSPP | 7760 | 110.201 |
| 1115 | TACCTAGAATCCAACTACACC | 6094 | YLESNYT | 7761 | 110.18 |
| 1116 | ACATTAGAAACAACCCGCAGC | 6095 | TLETTRS | 7762 | 110.167 |
| 1117 | TCCGCTAACGAACACAACCAC | 6096 | SANEHNH | 7763 | 110.137 |
| 1118 | GCACGAGTGGACACCAACCAA | 6097 | ARVDTNQ | 7764 | 110.09 |
| 1119 | AACGTGGTGAAAAACAACACA | 6098 | NVVKNNT | 7765 | 110.077 |
| 1120 | GGTTCTTATTCTGATGGTAGT | 6099 | GSYSDGS | 7766 | 110.0355 |
| 1121 | CCCGGTAACGGACAAAGTCCG | 6100 | PGNGQSP | 7767 | 110.0275 |
| 1122 | TCGGGGGTAAACTTCGGAGTA | 6101 | SGVNFGV | 7768 | 109.998 |
| 1123 | CGAATCAACGCAGCAATCGAC | 6102 | RINAAID | 7769 | 109.99675 |
| 1124 | CAAGCTGGGAACGCGCCAAGG | 6103 | QAGNAPR | 7770 | 109.98825 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1125 | CAGTCGGGGTCTCTGGTGCCG | 6104 | QSGSLVP | 7771 | 109.962 |
| 1126 | TTCTCAACGCAAGACATAAGC | 6105 | FSTQDIS | 7772 | 109.948 |
| 1127 | GTGAATCCGCATCCTGCGCAG | 6106 | VNPHPAQ | 7773 | 109.948 |
| 1128 | AAAGGCCACGCCTACGAAGCC | 6107 | KGHAYEA | 7774 | 109.897 |
| 1129 | GAAGACAGTATGAGATTCTCT | 6108 | EDSMRFS | 7775 | 109.874 |
| 1130 | GGTAGGAATGAGAGTCCGGAG | 6109 | GRNESPE | 7776 | 109.855 |
| 1131 | TCCGACGGATCGAAACTACTA | 6110 | SDGSKLL | 7777 | 109.8205 |
| 1132 | ACTCTCTCAGGCTACATGAGA | 6111 | TLSGYMR | 7778 | 109.808 |
| 1133 | GATATTCATAATCCGCGTACG | 6112 | DIHNPRT | 7779 | 109.789 |
| 1134 | TGGGCCAAAGACGTCAACGTC | 6113 | WAKDVNV | 7780 | 109.782 |
| 1135 | GCTGTGGGCGGTCGGATGAT | 6114 | AVGRSDD | 7781 | 109.711 |
| 1136 | AAAGAAAAAACCACCCGCGAA | 6115 | KEKTTRE | 7782 | 109.697 |
| 1137 | CTGCTCCAATCGACCTACTTG | 6116 | LLQSTYL | 7783 | 109.672 |
| 1138 | AAGTCTAATTTGGAGGGTAAG | 6117 | KSNLEGK | 7784 | 109.6285 |
| 1139 | ACGAGGACGCCTTTTCTGGGG | 6118 | TRTPFLG | 7785 | 109.613 |
| 1140 | CAGTCGGATACGACTTCGATT | 6119 | QSDTTSI | 7786 | 109.605 |
| 1141 | GCGTGGTCTCAAGTCCTGACG | 6120 | AWSQVLT | 7787 | 109.587 |
| 1142 | ACTCAAGAACGACCACTAATC | 6121 | TQERPLI | 7788 | 109.56 |
| 1143 | GATGATAAGACTGGTCGGTAT | 6122 | DDKTGRY | 7789 | 109.549 |
| 1144 | TTTCCTTCGCATAATGGGGCG | 6123 | FPSHNGA | 7790 | 109.54 |
| 1145 | ATGCTGTCTCAAGTCTTAACA | 6124 | MLSQVLT | 7791 | 109.536 |
| 1146 | TCTGTGACGACTAATCTGATG | 6125 | SVTTNLM | 7792 | 109.484 |
| 1147 | GAACACAACTCAAAAACTTAC | 6126 | EHNSKTY | 7793 | 109.4745 |
| 1148 | TATGCGCATCCTGTGACTCAT | 6127 | YAHPVTH | 7794 | 109.4635 |
| 1149 | CCTAATCCGTCTCCGAGGCAG | 6128 | PNPSPRQ | 7795 | 109.449 |
| 1150 | CATATGGGTTTGAATGAGCTT | 6129 | HMGLNEL | 7796 | 109.427 |
| 1151 | AACAGTTTGCAAGCAAGTGCA | 6130 | NSLQASA | 7797 | 109.402 |
| 1152 | GACCTCGGTACGGCTAGAACC | 6131 | DLGTART | 7798 | 109.388 |
| 1153 | TACGACAGCCGACTCTACGCG | 6132 | YDSRLYA | 7799 | 109.3853 |
| 1154 | CCGAAGCCTGGGACGGGGGAG | 6133 | PKPGTGE | 7800 | 109.3721 |
| 1155 | AGTCTGAATGGGGTGTTGGTT | 6134 | SLNGVLV | 7801 | 109.3685 |
| 1156 | CAGTCTAATTTGGTTATTAAT | 6135 | QSNLVIN | 7802 | 109.359 |
| 1157 | GCGTCTCCGGCGCAGACCGGC | 6136 | ASPAQTG | 7803 | 109.331 |
| 1158 | AACATGACCAACGAAAACGGA | 6137 | NMTNENG | 7804 | 109.324 |
| 1159 | TCACTTCGGACGGACGAATTC | 6138 | SLRTDEF | 7805 | 109.31815 |
| 1160 | ATATTGGACAACCACCGTTTC | 6139 | ILDNHRF | 7806 | 109.2685 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1161 | TTGATTAATATGAGTCAGAAT | 6140 | LINMSQN | 7807 | 109.264 |
| 1162 | CCGCAAGACGTCCGCCAAACA | 6141 | PQDVRQT | 7808 | 109.2625 |
| 1163 | CCCTTCGTAGCGAACGAACCA | 6142 | PFVANEP | 7809 | 109.256 |
| 1164 | AATATTAATGATACTAAGAAT | 6143 | NINDTKN | 7810 | 109.253 |
| 1165 | AATTTTAGTAGTGGTGATGTT | 6144 | NFSSGDV | 7811 | 109.229 |
| 1166 | GAACGAAACGGACTAATAGAA | 6145 | ERNGLIE | 7812 | 109.215 |
| 1167 | AATTCTCATGTTCCTAATAAT | 6146 | NSHVPNN | 7813 | 109.2115 |
| 1168 | AACACAACCGGTAGCTCGGGC | 6147 | NTTGSSG | 7814 | 109.1925 |
| 1169 | TCAACCAGAAAAGAACACGAC | 6148 | STRKEHD | 7815 | 109.1875 |
| 1170 | GCTGCTAATCCTAGTACGGAG | 6149 | AANPSTE | 7816 | 109.1357 |
| 1171 | TCGGGTATGAATAGTAATAAG | 6150 | SGMNSNK | 7817 | 109.129 |
| 1172 | AAGACGCTTGATAATAATGCT | 6151 | KTLDNNA | 7818 | 109.09305 |
| 1173 | ACCGTAAAACAAACAAGTCCG | 6152 | TVKQTSP | 7819 | 109.0863 |
| 1174 | ATTTCTCAGGTGTCTTTTAAT | 6153 | ISQVSFN | 7820 | 109.082 |
| 1175 | TTAGAAGTAAACCTGCAAACG | 6154 | LEVNLQT | 7821 | 109.057 |
| 1176 | GAAATGCAAACCAAAAACGCC | 6155 | EMQTKNA | 7822 | 109.052 |
| 1177 | GCCGACAACAGAAACGACAAA | 6156 | ADNRNDK | 7823 | 109.008 |
| 1178 | GCGTATGATACGCTGAATAGT | 6157 | AYDTLNS | 7824 | 108.982 |
| 1179 | ACGATTCAGGATCATATTAAG | 6158 | TIQDHIK | 7825 | 108.942 |
| 1180 | GACCCCACTAAAGTTGGATCC | 6159 | DPTKVGS | 7826 | 108.939 |
| 1181 | TCCCTCCAACGAACCCCCGAC | 6160 | SLQRTPD | 7827 | 108.937 |
| 1182 | GCAAACGACTCTGCCAAAACA | 6161 | ANDSAKT | 7828 | 108.9125 |
| 1183 | AAAAAGTCGAACAAGAACCA | 6162 | KKVEQEP | 7829 | 108.907 |
| 1184 | GCAAGTCGGGACCTGGGACAA | 6163 | ASRDLGQ | 7830 | 108.906 |
| 1185 | TGGGAGAGTGATAAGTTTCGT | 6164 | WESDKFR | 7831 | 108.876 |
| 1186 | AACCGCGGAACAGAAGTTTAC | 6165 | NRGTEVY | 7832 | 108.8187 |
| 1187 | AATATTAGTAGTATTAATCAG | 6166 | NISSINQ | 7833 | 108.8155 |
| 1188 | GCCTCGAAAGGCTTCGGCCAC | 6167 | ASKGFGH | 7834 | 108.7886 |
| 1189 | CAGTCGCAGAATGTGACTCAG | 6168 | QSQNVTQ | 7835 | 108.7825 |
| 1190 | AACGGATACCAACTACAAATC | 6169 | NGYQLQI | 7836 | 108.779 |
| 1191 | TGTACTAATGCGTCGGATCTT | 6170 | CTNASDL | 7837 | 108.74 |
| 1192 | ACCGTCGCCTCGCCCAACACC | 6171 | TVASPNT | 7838 | 108.738 |
| 1193 | AATACTGCTCCGCCGAATCAT | 6172 | NTAPPNH | 7839 | 108.733 |
| 1194 | CTTTCTCAACAACGCGACTAC | 6173 | LSQQRDY | 7840 | 108.69245 |
| 1195 | TGGAATCAGAATGTGTCTCAT | 6174 | WNQNVSH | 7841 | 108.6785 |
| 1196 | ACAGGTAGTTCAGACAGATTA | 6175 | TGSSDRL | 7842 | 108.676 |
| 1197 | AACACAACGCCACCTAACCAC | 6176 | NTTPPNH | 7843 | 108.602 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1198 | GTGGTCGACTCAACATACCCG | 6177 | VVDSTYP | 7844 | 108.592 |
| 1199 | ACGGATGCTACGGGGAGGCAT | 6178 | TDATGRH | 7845 | 108.5905 |
| 1200 | TTGTTTACTGCTGGGAGTACT | 6179 | LFTAGST | 7846 | 108.58 |
| 1201 | TTGCGTGATCAGACTAGTATG | 6180 | LRDQTSM | 7847 | 108.566 |
| 1202 | ATCGAAACGGACCGCCACCGG | 6181 | IETDRHR | 7848 | 108.531 |
| 1203 | AGTGGGCCTGAGAATACGTTG | 6182 | SGPENTL | 7849 | 108.526 |
| 1204 | GACAACCAAAACGCCGACAGG | 6183 | DNQNADR | 7850 | 108.486 |
| 1205 | CATGATGGTTATGTTCCTAAT | 6184 | HDGYVPN | 7851 | 108.469 |
| 1206 | CATATGTCTAGTTATTCGTCG | 6185 | HMSSYSS | 7852 | 108.436 |
| 1207 | AGTCGTCTGCAGACTCAGCAG | 6186 | SRLQTQQ | 7853 | 108.4358 |
| 1208 | TCATACACAGCAGGAAGACCC | 6187 | SYTAGRP | 7854 | 108.417 |
| 1209 | GTGCAGCAGAATAATATTAAT | 6188 | VQQNNIN | 7855 | 108.376 |
| 1210 | GATGCGAAGGCTCTTACGACT | 6189 | DAKALTT | 7856 | 108.368 |
| 1211 | AAGGATGAGCATCTTCATTAT | 6190 | KDEHLHY | 7857 | 108.358 |
| 1212 | CACGGTGACCGAACAGCTTTA | 6191 | HGDRTAL | 7858 | 108.327 |
| 1213 | AATTTTACTATTACGGAGGCG | 6192 | NFTITEA | 7859 | 108.32 |
| 1214 | GACACTCACATGAACAAACTG | 6193 | DTHMNKL | 7860 | 108.316 |
| 1215 | CAACCAGGAGCCCCCCAAACC | 6194 | QPGAPQT | 7861 | 108.312 |
| 1216 | GGGGAAGCACGCCGAGAAGCC | 6195 | GEARREA | 7862 | 108.302 |
| 1217 | AAGTCTCTTAGTAGTGATGAT | 6196 | KSLSSDD | 7863 | 108.2375 |
| 1218 | ATGAATACGACTTATAATGAG | 6197 | MNTTYNE | 7864 | 108.231 |
| 1219 | GCGGCCGCACTAGAAACAATA | 6198 | AAALETI | 7865 | 108.223 |
| 1220 | AACGTCGCTCCCTACAGTAGC | 6199 | NVAPYSS | 7866 | 108.21595 |
| 1221 | TCTGCGGGTATGGTGAGTCTG | 6200 | SAGMVSL | 7867 | 108.2145 |
| 1222 | TGCGACTTGTCACAATCATGC | 6201 | CDLSQSC | 7868 | 108.133 |
| 1223 | GTTTTGATTACGATGAGTTCG | 6202 | VLITMSS | 7869 | 108.118 |
| 1224 | CAAGTTGGGGCTCTAATGGTT | 6203 | QVGALMV | 7870 | 108.037 |
| 1225 | CAACGTACCTCGGAAGCGCCA | 6204 | QRTSEAP | 7871 | 108.0315 |
| 1226 | TTGGGTAATGGTAGTTCTTTG | 6205 | LGNGSSL | 7872 | 108.0135 |
| 1227 | CCTAGTGTCCGTTTGCCCTTA | 6206 | PSVRLPL | 7873 | 108.007 |
| 1228 | GATTCTGCTCCGAGTACTATT | 6207 | DSAPSTI | 7874 | 108.003 |
| 1229 | AATTATAATGGGGTTAATGTG | 6208 | NYNGVNV | 7875 | 107.956 |
| 1230 | TCGGCTCATCAGACGCCGACG | 6209 | SAHQTPT | 7876 | 107.932 |
| 1231 | GATCATAGTAAGCAGATTTCG | 6210 | DHSKQIS | 7877 | 107.923 |
| 1232 | GCCGCCAGCTTGTCGCAAAGC | 6211 | AASLSQS | 7878 | 107.914 |
| 1233 | CACGCCGACGTTGGCATGAGC | 6212 | HADVGMS | 7879 | 107.888 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1234 | CACGTGACAGTAACGTTAAAC | 6213 | HVTVTLN | 7880 | 107.8865 |
| 1235 | AATTCTACGCATATTAATTCG | 6214 | NSTHINS | 7881 | 107.8843 |
| 1236 | CTGGGGCTTGCTGGTCAGGTT | 6215 | LGLAGQV | 7882 | 107.884 |
| 1237 | AGCAGTCAAGCCCACGGCCCA | 6216 | SSQAHGP | 7883 | 107.872 |
| 1238 | GCTTTTAAGTCGGGTAGTATT | 6217 | AFKSGSI | 7884 | 107.866 |
| 1239 | CACTCCCCATCCCACGACTCG | 6218 | HSPSHDS | 7885 | 107.844 |
| 1240 | CCAAACGGCGAAAGTTCGCGA | 6219 | PNGESSR | 7886 | 107.8303 |
| 1241 | ATTCTTACGCCTTTGGATAAG | 6220 | ILTPLDK | 7887 | 107.825 |
| 1242 | TCCGCCTCTTACTCCAGGATG | 6221 | SASYSRM | 7888 | 107.815 |
| 1243 | GAGGCGTTGCATGATCGGAAT | 6222 | EALHDRN | 7889 | 107.793 |
| 1244 | GGTGAACAACACAACGCCCCC | 6223 | GEQHNAP | 7890 | 107.778 |
| 1245 | GGGAATATGGTTACGCCTAAT | 6224 | GNMVTPN | 7891 | 107.753 |
| 1246 | AACGCTCTCCTCAACGCACCT | 6225 | NALLNAP | 7892 | 107.742 |
| 1247 | GCAAGTGACCTACAAATGACG | 6226 | ASDLQMT | 7893 | 107.723 |
| 1248 | TCGTATGATATGCATACGAAT | 6227 | SYDMHTN | 7894 | 107.705 |
| 1249 | AATATGTCGCATAGTACTCTG | 6228 | NMSHSTL | 7895 | 107.6777 |
| 1250 | ACTGCCAACAACCACTCTCCG | 6229 | TANNHSP | 7896 | 107.671 |
| 1251 | CAAGCCCCGCCAACAGCACAA | 6230 | QAPPTAQ | 7897 | 107.668 |
| 1252 | AACTACCACGGAGACAACGTT | 6231 | NYHGDNV | 7898 | 107.637 |
| 1253 | AGGGATAGTACTATTAGTCGG | 6232 | RDSTISR | 7899 | 107.635 |
| 1254 | GTTTCTTCGCCTAATGGTACG | 6233 | VSSPNGT | 7900 | 107.6095 |
| 1255 | TCCCGAATCACGGTGAACGCA | 6234 | SRITVNA | 7901 | 107.593 |
| 1256 | GTCGGAACAACCTCGAACGGC | 6235 | VGTTSNG | 7902 | 107.575 |
| 1257 | CATACGAATCAGATGCAGCCT | 6236 | HTNQMQP | 7903 | 107.5573 |
| 1258 | AAAAGCAACGCGGGATTCGGT | 6237 | KSNAGFG | 7904 | 107.5065 |
| 1259 | AAAGAAAGCCTCGAAGACGTC | 6238 | KESLEDV | 7905 | 107.49 |
| 1260 | GCGCAGGTTAATAATCATGAT | 6239 | AQVNNHD | 7906 | 107.489 |
| 1261 | AACGCTTCTACCTACATGGAC | 6240 | NASTYMD | 7907 | 107.479 |
| 1262 | ACGTCTGATACGAATGCTAGG | 6241 | TSDTNAR | 7908 | 107.4605 |
| 1263 | GAGAGTCGTATGCGTAGTATT | 6242 | ESRMRSI | 7909 | 107.451 |
| 1264 | CGTGTTGAAGACACCAACTCC | 6243 | RVEDTNS | 7910 | 107.416 |
| 1265 | GCCTCTAACCACCTACAAGCC | 6244 | ASNHLQA | 7911 | 107.3863 |
| 1266 | CGCTTACACGGCTCAGACTCG | 6245 | RLHGSDS | 7912 | 107.358 |
| 1267 | ACCGTCGAACAAATAAACTCG | 6246 | TVEQINS | 7913 | 107.349 |
| 1268 | AGGTCCGTACCATCACCACAC | 6247 | RSVPSPH | 7914 | 107.343 |
| 1269 | GAATACCTCGCCCTGGGACAC | 6248 | EYLALGH | 7915 | 107.336 |
| 1270 | AATACTAATAATCAGGAGCAG | 6249 | NTNNQEQ | 7916 | 107.332 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1271 | AACTACGGTTCCGGACGAATC | 6250 | NYGSGRI | 7917 | 107.3205 |
| 1272 | CGCCACGGGGACACACCGATG | 6251 | RHGDTPM | 7918 | 107.303 |
| 1273 | AACGACACCATCGGCAGACCA | 6252 | NDTIGRP | 7919 | 107.2995 |
| 1274 | TATGGGAGCGTGCTAGGACG | 6253 | YGERART | 7920 | 107.297 |
| 1275 | GTTCTTGGGATGCAGAGGTCT | 6254 | VLGMQRS | 7921 | 107.295 |
| 1276 | CTTCATTTTCATGCTTCGCAG | 6255 | LHFHASQ | 7922 | 107.281 |
| 1277 | ACCGACACGCTCAGCGAAAGA | 6256 | TDTLSER | 7923 | 107.247 |
| 1278 | GGGACAGGTACCGTTGGATGG | 6257 | GTGTVGW | 7924 | 107.203 |
| 1279 | ACAGAAAGCCCCAAACTACTA | 6258 | TESPKLL | 7925 | 107.2015 |
| 1280 | ACGATTAGGAGTGAGGGTTTT | 6259 | TIRSEGF | 7926 | 107.1495 |
| 1281 | GCGTCTAGTTATATTAATAAT | 6260 | ASSYINN | 7927 | 107.144 |
| 1282 | TTACACCTTGGGTTATCATCT | 6261 | LHLGLSS | 7928 | 107.1415 |
| 1283 | GTCACTGGCACTACCCCGGGA | 6262 | VTGTTPG | 7929 | 107.137 |
| 1284 | GTGACGTCGTCTGCTAGTGGT | 6263 | VTSSASG | 7930 | 107.0606 |
| 1285 | CAAATGCACCTACACATGCAA | 6264 | QMHLHMQ | 7931 | 107.057 |
| 1286 | GGTACCATGAGTCTATTAATG | 6265 | GTMSLLM | 7932 | 107.046 |
| 1287 | TGCGCATCAGAAGTTTGCCAA | 6266 | CASEVCQ | 7933 | 107.035 |
| 1288 | AATCTTGTGATGAGTGGGACG | 6267 | NLVMSGT | 7934 | 107.0225 |
| 1289 | CAATCACTCAAAGACGGCACT | 6268 | QSLKDGT | 7935 | 106.991 |
| 1290 | GCGTTGAATGGTTCTGGTATT | 6269 | ALNGSGI | 7936 | 106.976 |
| 1291 | AGACACGTCGTCCCCGACTCC | 6270 | RHVVPDS | 7937 | 106.9705 |
| 1292 | CTGTATCATGATTCGCATCTT | 6271 | LYHDSHL | 7938 | 106.963 |
| 1293 | GGGAGTACGCCTATTACTTCT | 6272 | GSTPITS | 7939 | 106.957 |
| 1294 | CCCAACGACCAAATCAGCGGA | 6273 | PNDQISG | 7940 | 106.936 |
| 1295 | AGTGGAAAACAAGACAAATAC | 6274 | SGKQDKY | 7941 | 106.925 |
| 1296 | AGTGGGCATGCTTCTCAGGGT | 6275 | SGHASQG | 7942 | 106.8675 |
| 1297 | AAGATGGGGAGTATTGAGGTT | 6276 | KMGSIEV | 7943 | 106.864 |
| 1298 | TCAACTTTAGACCGAAGCGAA | 6277 | STLDRSE | 7944 | 106.8615 |
| 1299 | ACGGAGCTTAGTGAGTATACT | 6278 | TELSEYT | 7945 | 106.852 |
| 1300 | GCCAACGGAGGAGGATACCCC | 6279 | ANGGGYP | 7946 | 106.847 |
| 1301 | GTAACCGAATCTAACTCTCTA | 6280 | VTESNSL | 7947 | 106.83 |
| 1302 | CCAGTCTACGACCGCGACGTC | 6281 | PVYDRDV | 7948 | 106.812 |
| 1303 | GATAATAATAAGCATGGTACT | 6282 | DNNKHGT | 7949 | 106.806 |
| 1304 | ATCTACGAAACCGTAACCTTG | 6283 | IYETVTL | 7950 | 106.801 |
| 1305 | ACTCAGACTGGTCATGTTTCT | 6284 | TQTGHVS | 7951 | 106.7868 |
| 1306 | CAAGCCGACCTCAGGTACAAA | 6285 | QADLRYK | 7952 | 106.773 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1307 | TGTAAGACGAATAATGCTGGT | 6286 | CKTNNAG | 7953 | 106.749 |
| 1308 | GCCGGTCACCAACAACTGGCC | 6287 | AGHQQLA | 7954 | 106.7459 |
| 1309 | GATAGGGATATGGAGGGTGTT | 6288 | DRDMEGV | 7955 | 106.742 |
| 1310 | GATCAGCCGGGGTATGTGCGT | 6289 | DQPGYVR | 7956 | 106.7387 |
| 1311 | GATGCTATGCTTGCTCATCCG | 6290 | DAMLAHP | 7957 | 106.735 |
| 1312 | GCCCTTAACCTGTACTCCAGC | 6291 | ALNLYSS | 7958 | 106.732 |
| 1313 | CTACTATCTAAAGGGGACTCC | 6292 | LLSKGDS | 7959 | 106.709 |
| 1314 | TCGAGTATTAGTCTGCGGTAT | 6293 | SSISLRY | 7960 | 106.645 |
| 1315 | GGGTCGAGCCAACACCACGAA | 6294 | GSSQHHE | 7961 | 106.62 |
| 1316 | TCGATTGGGTATTCGCCTCCG | 6295 | SIGYSPP | 7962 | 106.5773 |
| 1317 | CACTCCAACGCGACTACGATA | 6296 | HSNATTI | 7963 | 106.567 |
| 1318 | TCGGCACACGACGCAAGACTA | 6297 | SAHDARL | 7964 | 106.5665 |
| 1319 | GTTCACACCGCAGACACAATA | 6298 | VHTADTI | 7965 | 106.564 |
| 1320 | CGAGACGGCTCTACTAAAGTT | 6299 | RDGSTKV | 7966 | 106.55855 |
| 1321 | TTGCAGGAGTCTCTTCCTGGT | 6300 | LQESLPG | 7967 | 106.542 |
| 1322 | TTAGACTACACCCCTCAAAAC | 6301 | LDYTPQN | 7968 | 106.519 |
| 1323 | GGACCAAGTTCGCACATCGTT | 6302 | GPSSHIV | 7969 | 106.507 |
| 1324 | AGCGCCGACACCCGGTCCCCC | 6303 | SADTRSP | 7970 | 106.466 |
| 1325 | ATGATGAAGAGTGAGGAGAAT | 6304 | MMKSEEN | 7971 | 106.425 |
| 1326 | GGTATGACGAGTGAGTTGACG | 6305 | GMTSELT | 7972 | 106.417 |
| 1327 | GTAGACACCTACAGCGGTCTG | 6306 | VDTYSGL | 7973 | 106.415 |
| 1328 | GGGATGAGGGATACGCCGCCG | 6307 | GMRDTPP | 7974 | 106.385 |
| 1329 | GAGCATGATGTGAGTACGCGT | 6308 | EHDVSTR | 7975 | 106.302 |
| 1330 | GAGGTGGTGAAGACTACTCAT | 6309 | EVVKTTH | 7976 | 106.269 |
| 1331 | GTTTACGACAACGTTTCTTCT | 6310 | VYDNVSS | 7977 | 106.268 |
| 1332 | CTCATGAAAGACATGGAATCC | 6311 | LMKDMES | 7978 | 106.2609 |
| 1333 | CCTCTTCATGTTGCTTCTCCT | 6312 | PLHVASP | 7979 | 106.239 |
| 1334 | GAAGTACGCGACCAAAAAACA | 6313 | EVRDQKT | 7980 | 106.2075 |
| 1335 | CCAACTCCCTACTACACCGCC | 6314 | PTPYYTA | 7981 | 106.124 |
| 1336 | AACAACTACGCCTACTCCGCT | 6315 | NNYAYSA | 7982 | 106.1085 |
| 1337 | CTTGTTGATACGGATAGGAAT | 6316 | LVDTDRN | 7983 | 106.108 |
| 1338 | TATCCGGCTGATCATCGGACT | 6317 | YPADHRT | 7984 | 106.088 |
| 1339 | TCTGCAACAACGAACCACGGA | 6318 | SATTNHG | 7985 | 106.066 |
| 1340 | CGTGATGATCAGCAGCTTGAT | 6319 | RDDQQLD | 7986 | 106.064 |
| 1341 | GGAGCGGGACAATCTCACGTG | 6320 | GAGQSHV | 7987 | 106.0351 |
| 1342 | GATAGGACTTATCATGAGGTG | 6321 | DRTYHEV | 7988 | 105.996 |
| 1343 | GATGGTAATAATACGACTTAT | 6322 | DGNNTTY | 7989 | 105.99 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1344 | GTGCATATGGAGTCGTATGCG | 6323 | VHMESYA | 7990 | 105.983 |
| 1345 | TGGTACGAAACAATCAGCCCG | 6324 | WYETISP | 7991 | 105.959 |
| 1346 | CTGTTGGGGGCTCATCAGCCG | 6325 | LLGAHQP | 7992 | 105.9002 |
| 1347 | CACGTACCTAACACTGAAGCA | 6326 | HVPNTEA | 7993 | 105.893 |
| 1348 | AATTCTCAGAATCCTCAGGGT | 6327 | NSQNPQG | 7994 | 105.8895 |
| 1349 | CTACAAGACCGGGCAACGAAC | 6328 | LQDRATN | 7995 | 105.864 |
| 1350 | ATTGTGAATCAGCATTCGGAG | 6329 | IVNQHSE | 7996 | 105.832 |
| 1351 | TTTGAGCAGGGTAAGGTTGAG | 6330 | FEQGKVE | 7997 | 105.811 |
| 1352 | GTGGCGACGGGTGTGTTTGCT | 6331 | VATGVFA | 7998 | 105.808 |
| 1353 | GACAAAATACAAAACGAAACA | 6332 | DKIQNET | 7999 | 105.784 |
| 1354 | ACGGACAACCCGTCCTACAAA | 6333 | TDNPSYK | 8000 | 105.771 |
| 1355 | GGCGTGAACACAAAAATCGAA | 6334 | GVNTKIE | 8001 | 105.7665 |
| 1356 | GGCTCTCACAACGGCCCAGCC | 6335 | GSHNGPA | 8002 | 105.763 |
| 1357 | TCCAACATGGGCGTAGCCTCT | 6336 | SNMGVAS | 8003 | 105.76 |
| 1358 | AACACGGACACTAACGAAAAA | 6337 | NTDTNEK | 8004 | 105.759 |
| 1359 | TCTGCGCTTTTGCGGATGGAT | 6338 | SALLRMD | 8005 | 105.707 |
| 1360 | CCTCAACTAAGCGGCACAGCG | 6339 | PQLSGTA | 8006 | 105.6914 |
| 1361 | TCTATTGTTAATAATGGGGCT | 6340 | SIVNNGA | 8007 | 105.684 |
| 1362 | AGCCTAGACCACGCCCCTCTA | 6341 | SLDHAPL | 8008 | 105.661 |
| 1363 | GACCACTCGAAACAAAACTCT | 6342 | DHSKQNS | 8009 | 105.653 |
| 1364 | CACAGTGACATGGTCAGCGGC | 6343 | HSDMVSG | 8010 | 105.642 |
| 1365 | CAGCATCGTGCGCAGGATGTG | 6344 | QHRAQDV | 8011 | 105.5608 |
| 1366 | GGTAGTACTAAGTCTGGGCAG | 6345 | GSTKSGQ | 8012 | 105.5509 |
| 1367 | ACAATGAGCGTAACTCTGGAA | 6346 | TMSVTLE | 8013 | 105.526 |
| 1368 | TATAATAATGGTGGGCATGTT | 6347 | YNNGGHV | 8014 | 105.516 |
| 1369 | GGTACTGCTGAGAATACGAGT | 6348 | GTAENTS | 8015 | 105.494 |
| 1370 | AATAGTTATGATGCGACGAGG | 6349 | NSYDATR | 8016 | 105.488 |
| 1371 | AGCGTCAACAACATGCGACTC | 6350 | SVNNMRL | 8017 | 105.4477 |
| 1372 | CTTAACTTACAATACACTCTG | 6351 | LNLQYTL | 8018 | 105.443 |
| 1373 | GAGGCGCAGACCGGCTGGGTT | 6352 | EAQTGWV | 8019 | 105.443 |
| 1374 | CCCGCTGAAGGAAACAACCGT | 6353 | PAEGNNR | 8020 | 105.442 |
| 1375 | TCTCTGGGTGGGAATCCGCCT | 6354 | SLGGNPP | 8021 | 105.4335 |
| 1376 | TATAATAGGGATAATGGTTCT | 6355 | YNRDNGS | 8022 | 105.4285 |
| 1377 | TTGACTGATCCTAAGGGGCAG | 6356 | LTDPKGQ | 8023 | 105.404 |
| 1378 | ACCCCAACAGGCACCAACAAA | 6357 | TPTGTNK | 8024 | 105.403 |
| 1379 | GTTCACGCTAACGCTACATTA | 6358 | VHANATL | 8025 | 105.38 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1380 | CGCGAAATAGTGCACTCAAAC | 6359 | REIVHSN | 8026 | 105.376 |
| 1381 | TACGCCGTCGCGATAGGCACA | 6360 | YAVAIGT | 8027 | 105.366 |
| 1382 | AACACAACACCTCCCGACCAC | 6361 | NTTPPDH | 8028 | 105.348 |
| 1383 | GTTATTCAGTCTGATAATACG | 6362 | VIQSDNT | 8029 | 105.32 |
| 1384 | GTTCCGGCGCATTCTCGGGGT | 6363 | VPAHSRG | 8030 | 105.305 |
| 1385 | CAAAACAGTGACCTCGCCAGC | 6364 | QNSDLAS | 8031 | 105.296 |
| 1386 | CGCATCGTAGACACGTTGGGA | 6365 | RIVDTLG | 8032 | 105.2825 |
| 1387 | CACACTTACTCACAAGCAGAC | 6366 | HTYSQAD | 8033 | 105.267 |
| 1388 | ACGGCTCCATCCGTAGGGTCT | 6367 | TAPSVGS | 8034 | 105.259 |
| 1389 | AACGTGGGCACCGACAGAGAC | 6368 | NVGTDRD | 8035 | 105.231 |
| 1390 | GGGATTAATCGTACTAGTGAG | 6369 | GINRTSE | 8036 | 105.2145 |
| 1391 | GTAGAAACAGACAGCTTAATA | 6370 | VETDSLI | 8037 | 105.195 |
| 1392 | CACTCCGCAGCGGGTGACGGT | 6371 | HSAAGDG | 8038 | 105.195 |
| 1393 | GATGCTGGGATTAGTTCTTAT | 6372 | DAGISSY | 8039 | 105.102 |
| 1394 | TGCACCGCCACAAAATGCTCA | 6373 | CTATKCS | 8040 | 105.0959 |
| 1395 | CGCATAGACACTCTCCTAGTC | 6374 | RIDTLLV | 8041 | 105.089 |
| 1396 | GTATCACAATCACACGACGTG | 6375 | VSQSHDV | 8042 | 105.087 |
| 1397 | GCACTACCATCCCACTCCTCC | 6376 | ALPSHSS | 8043 | 105.059 |
| 1398 | GGGAAACCTGCGGAAGCGCCG | 6377 | GKPAEAP | 8044 | 105.055 |
| 1399 | TGGAATAGTCCGGGTGAGGCG | 6378 | WNSPGEA | 8045 | 105.053 |
| 1400 | AGGCTGGAGCGTCCGGATTAT | 6379 | RLERPDY | 8046 | 105.04 |
| 1401 | ACGCGGGAGAGTCTGGTGGAT | 6380 | TRESLVD | 8047 | 105.022 |
| 1402 | AGACACGAAGGTCCGTACTCC | 6381 | RHEGPYS | 8048 | 105.002 |
| 1403 | GTTTTGTCTGATAAGGCGTTT | 6382 | VLSDKAF | 8049 | 104.981 |
| 1404 | ACTAGTGCGACTGATTCGATG | 6383 | TSATDSM | 8050 | 104.908 |
| 1405 | ACTGAGCCGCTTCCGATGTCT | 6384 | TEPLPMS | 8051 | 104.869 |
| 1406 | ATGCCTTACGTCGGGACAGTA | 6385 | MPYVGTV | 8052 | 104.838 |
| 1407 | CGTGATTATTCTCCTACTGAT | 6386 | RDYSPTD | 8053 | 104.836 |
| 1408 | CGGAATGGTGGTACTACGGAT | 6387 | RNGGTTD | 8054 | 104.7625 |
| 1409 | ATGATGGGCGCGACAACGAAA | 6388 | MMGATTK | 8055 | 104.7503 |
| 1410 | GCTGCCGTTGGCGGAGACACC | 6389 | AAVGGDT | 8056 | 104.742 |
| 1411 | CTTGTGAATAATGATGGGACT | 6390 | LVNNDGT | 8057 | 104.7255 |
| 1412 | AGTTCGACTCCGCAGGATACT | 6391 | SSTPQDT | 8058 | 104.713 |
| 1413 | AGTCTGCGGATGGAGAATAGT | 6392 | SLRMENS | 8059 | 104.7025 |
| 1414 | GTGCAGGGGCAGACCGGCTGG | 6393 | VQGQTGW | 8060 | 104.688 |
| 1415 | CTAGGTTTCACACCCCAACCG | 6394 | LGFTPQP | 8061 | 104.677 |
| 1416 | TCGGTTGCTAAGGATCAGACG | 6395 | SVAKDQT | 8062 | 104.675 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1417 | CCGCGGCATGAGTTGAGTAAT | 6396 | PRHELSN | 8063 | 104.645 |
| 1418 | AAAATGGGATCGAACCCCGCA | 6397 | KMGSNPA | 8064 | 104.6241 |
| 1419 | GAGGCGACTCATGGTTCTTAT | 6398 | EATHGSY | 8065 | 104.613 |
| 1420 | CCTGAGGTTGCGTGTCCTGGG | 6399 | PEVACPG | 8066 | 104.595 |
| 1421 | GTGAATACGCGGGAGGTTACG | 6400 | VNTREVT | 8067 | 104.583 |
| 1422 | ACGGCTCGTGCGATTGATATG | 6401 | TARAIDM | 8068 | 104.551 |
| 1423 | ACCGACGGCGCCCTGGGTTAC | 6402 | TDGALGY | 8069 | 104.5325 |
| 1424 | GGGTCGCAATACGCGAACCGC | 6403 | GSQYANR | 8070 | 104.524 |
| 1425 | GAAATGGGTAACCAATACCCA | 6404 | EMGNQYP | 8071 | 104.453 |
| 1426 | CCGTCGACACTCGCTGAAACA | 6405 | PSTLAET | 8072 | 104.449 |
| 1427 | CGCATAGGCGTTGGAGCACCA | 6406 | RIGVGAP | 8073 | 104.4405 |
| 1428 | CTGAGTGTGAAGGAGGAGATT | 6407 | LSVKEEI | 8074 | 104.435 |
| 1429 | TATACTACTCATGAGAGTGGG | 6408 | YTTHESG | 8075 | 104.433 |
| 1430 | CTTACTGCTGTTCTGACTGTT | 6409 | LTAVLTV | 8076 | 104.424 |
| 1431 | CTGCAGACTTCTGTTGCTACT | 6410 | LQTSVAT | 8077 | 104.42 |
| 1432 | ACTGTGCGTTCGCCTCAGCCG | 6411 | TVRSPQP | 8078 | 104.391 |
| 1433 | CATCCTGATGGTACTCGGCCG | 6412 | HPDGTRP | 8079 | 104.375 |
| 1434 | GGAGTAACAATCGGTAGCAGG | 6413 | GVTIGSR | 8080 | 104.3732 |
| 1435 | ACATACGCCTCTACTGAAGCG | 6414 | TYASTEA | 8081 | 104.3675 |
| 1436 | AGGAGTAGTCCTGCGACGAAT | 6415 | RSSPATN | 8082 | 104.355 |
| 1437 | ATCGGGTCGCCGTTGGCCAAC | 6416 | IGSPLAN | 8083 | 104.35 |
| 1438 | GCGTCGACTGAGTCTCATGTG | 6417 | ASTESHV | 8084 | 104.344 |
| 1439 | ATTGCGCAGAATGAGACGTAT | 6418 | IAQNETY | 8085 | 104.336 |
| 1440 | ATGGAGTCTAAGCCGTGGCAG | 6419 | MESKPWQ | 8086 | 104.307 |
| 1441 | TTAGAAAACCCAACACCAGCA | 6420 | LENPTPA | 8087 | 104.305 |
| 1442 | CCCAACCCCAGTCCAAGACAA | 6421 | PNPSPRQ | 8088 | 104.258 |
| 1443 | TCGACTAGTAATCCGCCTTAT | 6422 | STSNPPY | 8089 | 104.242 |
| 1444 | TATTTGACGGATACTCCTACT | 6423 | YLTDTPT | 8090 | 104.241 |
| 1445 | ATACGTGCATTGATGACGGAC | 6424 | IRALMTD | 8091 | 104.237 |
| 1446 | CCTATGGGTACGGATACGGTT | 6425 | PMGTDTV | 8092 | 104.221 |
| 1447 | ACGAGGACTCAGGGGACGTCT | 6426 | TRTQGTS | 8093 | 104.19625 |
| 1448 | TCTAATAATATGAATCAGGCG | 6427 | SNNMNQA | 8094 | 104.187 |
| 1449 | GAAGACTCTGTAAACCACATC | 6428 | EDSVNHI | 8095 | 104.185 |
| 1450 | TCTGTTGTGCCTACGGATAAG | 6429 | SVVPTDK | 8096 | 104.174 |
| 1451 | GTGCGCGGCGTTCAAGACGCC | 6430 | VRGVQDA | 8097 | 104.167 |
| 1452 | CATGATGTGACTGTGCGGAAT | 6431 | HDVTVRN | 8098 | 104.164 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1453 | CATAATAATCATGCGGGTGAG | 6432 | HNNHAGE | 8099 | 104.153 |
| 1454 | GGTAATATGAATCATAGTATT | 6433 | GNMNHSI | 8100 | 104.15 |
| 1455 | GGTGTGCATACTCATACTGTT | 6434 | GVHTHTV | 8101 | 104.139 |
| 1456 | TTTTTGCCGCAGCTGGGGCAG | 6435 | FLPQLGQ | 8102 | 104.094 |
| 1457 | TTGGCCAACATGTCCGCACCA | 6436 | LANMSAP | 8103 | 104.093 |
| 1458 | GTTCGCAGAGACGAAACACCT | 6437 | VRRDETP | 8104 | 104.0585 |
| 1459 | TGCCGCGACAACGTCTTAGCT | 6438 | CRDNVLA | 8105 | 104.046 |
| 1460 | ATGTTGGCTTCTCGGGTGCCT | 6439 | MLASRVP | 8106 | 104.0205 |
| 1461 | GTCAGAACAGTCCTTCAACAA | 6440 | VRTVLQQ | 8107 | 104.017 |
| 1462 | TCGAATCAGAATGTGGATTGG | 6441 | SNQNVDW | 8108 | 104 |
| 1463 | ACTGAGGTTACGGGGGATAGT | 6442 | TEVTGDS | 8109 | 103.965 |
| 1464 | GAAAGTGCCACATCTCTAAAA | 6443 | ESATSLK | 8110 | 103.9355 |
| 1465 | AACCACCCCGCACCAAGCTCA | 6444 | NHPAPSS | 8111 | 103.9235 |
| 1466 | TACGGTAACGCGAACACCGTA | 6445 | YGNANTV | 8112 | 103.92115 |
| 1467 | CAAAACGACAAATCTGACAAC | 6446 | QNDKSDN | 8113 | 103.9165 |
| 1468 | AGTCAGGCTCAGATTCGTGTT | 6447 | SQAQIRV | 8114 | 103.915 |
| 1469 | TTTCAGCGTGATGTTGGTCAT | 6448 | FQRDVGH | 8115 | 103.8651 |
| 1470 | CTGATGAATCGTAATGCTCCT | 6449 | LMNRNAP | 8116 | 103.8648 |
| 1471 | GCGGGCAGTTCGCCATCACGC | 6450 | AGSSPSR | 8117 | 103.8635 |
| 1472 | TTATTCCACAGCCAAATGACC | 6451 | LFHSQMT | 8118 | 103.849 |
| 1473 | ATGATGTCTAACAGCCTCGCG | 6452 | MMSNSLA | 8119 | 103.8275 |
| 1474 | GTTACCACCGTCCTCCAATCA | 6453 | VTTVLQS | 8120 | 103.818 |
| 1475 | GGTAGTCAGCGTGCTATGAAT | 6454 | GSQRAMN | 8121 | 103.8086 |
| 1476 | GCATCCGGCGCACGCTACGTC | 6455 | ASGARYV | 8122 | 103.7981 |
| 1477 | AAAAACTACGACAGTGACTCA | 6456 | KNYDSDS | 8123 | 103.794 |
| 1478 | GTGGGTTCTGGGGTTGGGGTT | 6457 | VGSGVGV | 8124 | 103.793 |
| 1479 | CGTTCTGACCTTACTGAAAGT | 6458 | RSDLTES | 8125 | 103.736 |
| 1480 | AGGGCGGAGTTTATTGATACG | 6459 | RAEFIDT | 8126 | 103.735 |
| 1481 | ACATCTGAAATGCGGACAGCC | 6460 | TSEMRTA | 8127 | 103.725 |
| 1482 | GAGTTGGATCATCTTTCGCAT | 6461 | ELDHLSH | 8128 | 103.714 |
| 1483 | ACACAAGCAGGTCTTGCGTCA | 6462 | TQAGLAS | 8129 | 103.696 |
| 1484 | GCGGCTCAGCATCATGATACG | 6463 | AAQHHDT | 8130 | 103.693 |
| 1485 | GGCGGCGCACACACTCGTGTA | 6464 | GGAHTRV | 8131 | 103.676 |
| 1486 | GCCTACGGTATACACGAAGTG | 6465 | AYGIHEV | 8132 | 103.653 |
| 1487 | GCGATGCTGCGTATGGAGCAG | 6466 | AMLRMEQ | 8133 | 103.652 |
| 1488 | ACGGATCGTTCGCGGCTGGGG | 6467 | TDRSRLG | 8134 | 103.622 |
| 1489 | GAGAGGGAGCCTCCTAAGAAT | 6468 | EREPPKN | 8135 | 103.621 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1490 | GTTGTTAAGGAGATTAAGCTG | 6469 | VVKEIKL | 8136 | 103.6125 |
| 1491 | CACACCGGCCAAACACCATCA | 6470 | HTGQTPS | 8137 | 103.5945 |
| 1492 | GTGTCTCTGAGTTCGCCTCCG | 6471 | VSLSSPP | 8138 | 103.563 |
| 1493 | GGGGCAGGAAACCTGGGTACC | 6472 | GAGNLGT | 8139 | 103.5615 |
| 1494 | GCACGAGACGACACGATACAA | 6473 | ARDDTIQ | 8140 | 103.523 |
| 1495 | GGGACTTATACTAATATGCCG | 6474 | GTYTNMP | 8141 | 103.522 |
| 1496 | ATGCTGGGGGGTTTTGCGCAG | 6475 | MLGGFAQ | 8142 | 103.5051 |
| 1497 | CCATCCGAAATGAGGGCCGTA | 6476 | PSEMRAV | 8143 | 103.503 |
| 1498 | CGTATAAGCCCAGAAAACTCA | 6477 | RISPENS | 8144 | 103.497 |
| 1499 | AAGATGGGTGGTTCTCAGAGT | 6478 | KMGGSQS | 8145 | 103.477 |
| 1500 | GGTTTGATGGCGCATGTGACT | 6479 | GLMAHVT | 8146 | 103.464 |
| 1501 | TCACGTCAAACAGCGCTAACA | 6480 | SRQTALT | 8147 | 103.4599 |
| 1502 | AGTGATCTGAATCTTCCGCCG | 6481 | SDLNLPP | 8148 | 103.455 |
| 1503 | TATGTGTCTGATTATTTGCAT | 6482 | YVSDYLH | 8149 | 103.393 |
| 1504 | ACTAATGATAATAGTGATCGT | 6483 | TNDNSDR | 8150 | 103.374 |
| 1505 | TACTTAATGCACGACAGCGCA | 6484 | YLMHDSA | 8151 | 103.369 |
| 1506 | GGCTCTCGGAACGGACCCACA | 6485 | GSRNGPT | 8152 | 103.3096 |
| 1507 | AAAAACGGTGTTATAAACGAC | 6486 | KNGVIND | 8153 | 103.292 |
| 1508 | GAGTCTGTTGCTAATCTTAAG | 6487 | ESVANLK | 8154 | 103.162 |
| 1509 | GCATCGGACTCGACGACACCA | 6488 | ASDSTTP | 8155 | 103.149 |
| 1510 | CTGAACGTTAGTTCATCCAAA | 6489 | LNVSSSK | 8156 | 103.149 |
| 1511 | GAGGCTAAGGGTTTTGGTCAT | 6490 | EAKGFGH | 8157 | 103.1228 |
| 1512 | GGTACGAGTGCGGAGAGTCGG | 6491 | GTSAESR | 8158 | 103.111 |
| 1513 | ATGCACAACCTACCCTCATAC | 6492 | MHNLPSY | 8159 | 103.10145 |
| 1514 | GTCTTCACAGAAATAGAATCG | 6493 | VFTEIES | 8160 | 103.101 |
| 1515 | ACTCAAACTTCTACCTGGACC | 6494 | TQTSTWT | 8161 | 103.094 |
| 1516 | CCTATGAATAAGGATATTTTG | 6495 | PMNKDIL | 8162 | 103.07 |
| 1517 | AAAGAATCTGAATACAGAGTT | 6496 | KESEYRV | 8163 | 103.07 |
| 1518 | TCGACGAATTCTGAGGCGGTT | 6497 | STNSEAV | 8164 | 103.068 |
| 1519 | GATACGGCGAATCGTTCGACT | 6498 | DTANRST | 8165 | 103.03715 |
| 1520 | CCTAAGGCTCCGCTTAATAAT | 6499 | PKAPLNN | 8166 | 103.032 |
| 1521 | TTAGCTACATACCCCTCCCAC | 6500 | LATYPSH | 8167 | 103.028 |
| 1522 | GCTACGGTTCAGTCGGTTGAT | 6501 | ATVQSVD | 8168 | 103.011 |
| 1523 | AATTCGATGGGTAATGGGGGT | 6502 | NSMGNGG | 8169 | 103.009 |
| 1524 | GATCATAGTGAGCAGAATTCG | 6503 | DHSEQNS | 8170 | 102.995 |
| 1525 | ACTTTTTTGCCTCAGCTTGGG | 6504 | TFLPQLG | 8171 | 102.994 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1526 | GGGTTTACTAATACGAGTAAG | 6505 | GFTNTSK | 8172 | 102.9895 |
| 1527 | ACGATGAATTATAGTCATACT | 6506 | TMNYSHT | 8173 | 102.962 |
| 1528 | AGTATCGGATTCTCAGTAGGC | 6507 | SIGFSVG | 8174 | 102.9565 |
| 1529 | AGTGAGAATCGGGCTGGTAAT | 6508 | SENRAGN | 8175 | 102.945 |
| 1530 | AGTCTTAATCTGCATAGTGTG | 6509 | SLNLHSV | 8176 | 102.93 |
| 1531 | CATGAGAGTCATTATGTTAGT | 6510 | HESHYVS | 8177 | 102.921 |
| 1532 | AATGTTGTTAATGGGATGGAT | 6511 | NVVNGMD | 8178 | 102.908 |
| 1533 | CACTCCGACAAAGTCTCCTCA | 6512 | HSDKVSS | 8179 | 102.8992 |
| 1534 | AAATCTGTAGGCGACGGGAGA | 6513 | KSVGDGR | 8180 | 102.8979 |
| 1535 | AGGCAGGTTGAGCAGTCTGAT | 6514 | RQVEQSD | 8181 | 102.889 |
| 1536 | AGGGAGCTGGTGAATACGGAT | 6515 | RELVNTD | 8182 | 102.87 |
| 1537 | AACTACAGGGACATCACAATG | 6516 | NYRDITM | 8183 | 102.8605 |
| 1538 | GCCAGCCTTGACCGCCTTCCA | 6517 | ASLDRLP | 8184 | 102.857 |
| 1539 | AGACAACTTGCTTCTCTCCCA | 6518 | RQLASLP | 8185 | 102.846 |
| 1540 | GTCAGCAAAACCAAAGACTCG | 6519 | VSKTKDS | 8186 | 102.832 |
| 1541 | AACGTATACGAAGGGCACCGC | 6520 | NVYEGHR | 8187 | 102.815 |
| 1542 | CTAGAACAACTACGGGTCCCA | 6521 | LEQLRVP | 8188 | 102.815 |
| 1543 | ATGACCTACACATCCCCAACC | 6522 | MTYTSPT | 8189 | 102.807 |
| 1544 | AACTCCCACACCGACAGAGGA | 6523 | NSHTDRG | 8190 | 102.801 |
| 1545 | GTGGCTGGGGGACTTCGGAG | 6524 | VAGGTSE | 8191 | 102.789 |
| 1546 | GTCGACGCACACAGGGCTAAC | 6525 | VDAHRAN | 8192 | 102.77 |
| 1547 | CGGGCAGACATGACTCCCTTA | 6526 | RADMTPL | 8193 | 102.77 |
| 1548 | GGACACGAACAAACTGACGCA | 6527 | GHEQTDA | 8194 | 102.764 |
| 1549 | TACATCGCGGGAGGCGACCAA | 6528 | YIAGGDQ | 8195 | 102.75 |
| 1550 | TACGGCGACCTAACTACAGTC | 6529 | YGDLTTV | 8196 | 102.737 |
| 1551 | AGATTAGACCTGCAAGAACAC | 6530 | RLDLQEH | 8197 | 102.719 |
| 1552 | CACCTTAACCCGGCGGCCCAA | 6531 | HLNPAAQ | 8198 | 102.719 |
| 1553 | GGGGTTAACGAACAAACAAAC | 6532 | GVNEQTN | 8199 | 102.703 |
| 1554 | CGTCGGTTGAGTACGGATCTT | 6533 | RRLSTDL | 8200 | 102.702 |
| 1555 | GGATCCACAGGCCTACCCCCG | 6534 | GSTGLPP | 8201 | 102.7015 |
| 1556 | GACGACATGGTCAAAAACTCA | 6535 | DDMVKNS | 8202 | 102.6815 |
| 1557 | GTTATAGACCTAGTCACTCGC | 6536 | VIDLVTR | 8203 | 102.673 |
| 1558 | GGAGGCCTTACCAACGGTCTA | 6537 | GGLTNGL | 8204 | 102.67 |
| 1559 | CGTATGGAGGAGACTGCTTAT | 6538 | RMEETAY | 8205 | 102.6535 |
| 1560 | ACCGACATCTCCGGTTACGGA | 6539 | TDISGYG | 8206 | 102.642 |
| 1561 | CAGGTTAATCATAATACTAGT | 6540 | QVNHNTS | 8207 | 102.637 |
| 1562 | GCGACTACTGAGGATGTTCGT | 6541 | ATTEDVR | 8208 | 102.626 |

TABLE 3-continued

MHCK7/CK8 Combined Results mRNA Second Round of Capsid Variant
Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
| --- | --- | --- | --- | --- | --- |
| 1563 | TGGAGCATCAAAAACCAAACA | 6542 | WSIKNQT | 8209 | 102.586 |
| 1564 | TCCCCTACCAGCAACACAATA | 6543 | SPTSNTI | 8210 | 102.584 |
| 1565 | ATGAAAAACTCTGGATTCGAC | 6544 | MKNSGFD | 8211 | 102.583 |
| 1566 | CTTGTTGCTGAGCGTTTGCCG | 6545 | LVAERLP | 8212 | 102.552 |
| 1567 | GGTGAAACTAACTTCCCAACT | 6546 | GETNFPT | 8213 | 102.532 |
| 1568 | AATGGTAAGCTGGGTACGACT | 6547 | NGKLGTT | 8214 | 102.52735 |
| 1569 | AACTTAGTAGCGTACACGAAA | 6548 | NLVAYTK | 8215 | 102.5245 |
| 1570 | TGGCAGCTTACGACGAGTCAT | 6549 | WQLTTSH | 8216 | 102.497 |
| 1571 | AGTTTGGACCTAGGAGGCAAC | 6550 | SLDLGGN | 8217 | 102.491 |
| 1572 | AACGAAAGCACCAAAGAATCT | 6551 | NESTKES | 8218 | 102.483 |
| 1573 | GGTTTTGATGGTAAGCAGCTT | 6552 | GFDGKQL | 8219 | 102.462 |
| 1574 | CATCTGTATATTTCGGCGGAT | 6553 | HLYISAD | 8220 | 102.442 |
| 1575 | TTACTTCCAAACAACACCCAC | 6554 | LLPNNTH | 8221 | 102.424 |
| 1576 | TCCGGAATGGCCGGCCTTTCC | 6555 | SGMAGLS | 8222 | 102.423 |
| 1577 | ATCACCTCACTCCCCGAAACC | 6556 | ITSLPET | 8223 | 102.414 |
| 1578 | GAGCTTAAGGAGAGTCAGAAG | 6557 | ELKESQK | 8224 | 102.408 |
| 1579 | AATATTGTGCAGGATTATCCG | 6558 | NIVQDYP | 8225 | 102.404 |
| 1580 | TCAGAAAACACCTCTGTACCC | 6559 | SENTSVP | 8226 | 102.388 |
| 1581 | GACCCCAACCAACCCAAAACA | 6560 | DPNQPKT | 8227 | 102.376 |
| 1582 | GCGGGTTTGGATGTGAATACG | 6561 | AGLDVNT | 8228 | 102.372 |
| 1583 | TCTCATGAGATGAATAATGGT | 6562 | SHEMNNG | 8229 | 102.366 |
| 1584 | TCTTACGCCATAAACCAATCA | 6563 | SYAINQS | 8230 | 102.335 |
| 1585 | GGTCATCTGCCTGCGGCTAAG | 6564 | GHLPAAK | 8231 | 102.315 |
| 1586 | GAGTTGGGTAATAAGACGGCT | 6565 | ELGNKTA | 8232 | 102.311 |
| 1587 | CTTGAGTCTACTCGTAAGGCT | 6566 | LESTRKA | 8233 | 102.31 |
| 1588 | ACTCAAGGCAACTCTGAAGCA | 6567 | TQGNSEA | 8234 | 102.31 |
| 1589 | ATCTCTATAGACTCCGCTATG | 6568 | ISIDSAM | 8235 | 102.301 |
| 1590 | GAGTTTCAGAGGATTCGTGAG | 6569 | EFQRIRE | 8236 | 102.259 |
| 1591 | GCTAGTCTCTCCGCACCAGCC | 6570 | ASLSAPA | 8237 | 102.227 |
| 1592 | GACAGCCAAATCACAAGACTA | 6571 | DSQITRL | 8238 | 102.218 |
| 1593 | GGCCACGAAAACATGGGCGTG | 6572 | GHENMGV | 8239 | 102.215 |
| 1594 | ATGTCGGCGGGGCATCCTACG | 6573 | MSAGHPT | 8240 | 102.207 |
| 1595 | CACGCTCCAAGCGGCGCCATA | 6574 | HAPSGAI | 8241 | 102.2 |
| 1596 | ACGACTATTACTAATTCGGTT | 6575 | TTITNSV | 8242 | 102.187 |
| 1597 | CCTCAGCATCAGCATGAGCAT | 6576 | PQHQHEH | 8243 | 102.1805 |
| 1598 | CAATACTCGATGGACACGCGC | 6577 | QYSMDTR | 8244 | 102.173 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1599 | CTTTATGAGGTTGGTACTCCT | 6578 | LYEVGTP | 8245 | 102.165 |
| 1600 | GGTGAGACTATGCGTCATAAT | 6579 | GETMRHN | 8246 | 102.119 |
| 1601 | ATGACAATAACCGTCGAACCG | 6580 | MTITVEP | 8247 | 102.096 |
| 1602 | GCGCAGCATCCTGAGCGTTCG | 6581 | AQHPERS | 8248 | 102.084 |
| 1603 | ACGCATGTTGCTAAGCCTGAT | 6582 | THVAKPD | 8249 | 102.082 |
| 1604 | ATGACTGCTAACTTGGTGGAA | 6583 | MTANLVE | 8250 | 102.076 |
| 1605 | AATAGGCAGCGGGATTTTGAG | 6584 | NRQRDFE | 8251 | 102.073 |
| 1606 | TCAAACAGCGCCGACGCGGGG | 6585 | SNSADAG | 8252 | 102.047 |
| 1607 | GGTGAGTATGGTGCGTCGGTT | 6586 | GEYGASV | 8253 | 102.037 |
| 1608 | GACGGCATGGTCAGGTCGACA | 6587 | DGMVRST | 8254 | 102.025 |
| 1609 | AATGGTCAGCTGCTGGCTAAT | 6588 | NGQLLAN | 8255 | 102.023 |
| 1610 | TCCGCGGGGATGACATTGGAC | 6589 | SAGMTLD | 8256 | 102.016 |
| 1611 | GATCATGTGCATCTGACTTAT | 6590 | DHVHLTY | 8257 | 102.008 |
| 1612 | ACGACACTAACGCAAACGGAC | 6591 | TTLTQTD | 8258 | 102.003 |
| 1613 | GTGCAGTTGGCTGATGGGCAT | 6592 | VQLADGH | 8259 | 102.003 |
| 1614 | ACTGACTCATCTGCAGACTCC | 6593 | TDSSADS | 8260 | 101.981 |
| 1615 | GCGATGAATGTGCGGAGTGAT | 6594 | AMNVRSD | 8261 | 101.9805 |
| 1616 | GGTGATATTTCTTATAGGGTT | 6595 | GDISYRV | 8262 | 101.977 |
| 1617 | ATGGGGTATGTTGATAGTCTG | 6596 | MGYVDSL | 8263 | 101.953 |
| 1618 | CTTTATTTGGCGGCGGCTTCG | 6597 | LYLAAAS | 8264 | 101.948 |
| 1619 | TCATCCCCAGACTCGTACAGA | 6598 | SSPDSYR | 8265 | 101.921 |
| 1620 | AGTTATAATGTGGATCTGCAT | 6599 | SYNVDLH | 8266 | 101.892 |
| 1621 | CAACACACCGCCCACCCCATG | 6600 | QHTAHPM | 8267 | 101.892 |
| 1622 | GCAGTTATGGCTACACACCCC | 6601 | AVMATHP | 8268 | 101.87 |
| 1623 | ATTAGTCCGAGTGCTTCTAAT | 6602 | ISPSASN | 8269 | 101.855 |
| 1624 | ACTTTGGATAATAATCATTCT | 6603 | TLDNNHS | 8270 | 101.833 |
| 1625 | AGTGGGTCTTATGTGGCGACG | 6604 | SGSYVAT | 8271 | 101.806 |
| 1626 | ATGGCGGCTCCGCCGGAGCAT | 6605 | MAAPPEH | 8272 | 101.802 |
| 1627 | CAGACTGCGTCTGGTGATACT | 6606 | QTASGDT | 8273 | 101.7725 |
| 1628 | GAGTCTAAGACTGTGGTTATT | 6607 | ESKTVVI | 8274 | 101.7695 |
| 1629 | ACGGTATTACCACAATCAGAC | 6608 | TVLPQSD | 8275 | 101.744 |
| 1630 | CCATTAAACGCGAACGGCTCC | 6609 | PLNANGS | 8276 | 101.7415 |
| 1631 | CCCCTGAACACAGGATTAACC | 6610 | PLNTGLT | 8277 | 101.718 |
| 1632 | GCCATAACGATAATAGGCACT | 6611 | AITIIGT | 8278 | 101.711 |
| 1633 | AATCCTAGTGCGATTAGTTAT | 6612 | NPSAISY | 8279 | 101.687 |
| 1634 | ACAGAACACGAAAAATCCACT | 6613 | TEHEKST | 8280 | 101.66205 |
| 1635 | GCTGAGAGTCAGCTGGCGTCG | 6614 | AESQLAS | 8281 | 101.655 |

TABLE 3-continued

MHCK7/CK8 Combined Results mRNA Second Round of Capsid Variant Selection in C57BL6 mice-score capped at 100

| Variant ID for Table | Nucleotide Sequence | SEQ ID NO: | Amino Acid seq. | SEQ ID NO: | Sum of muscle mRNA score_capped at 100 |
|---|---|---|---|---|---|
| 1636 | GTGCTTAAGGGTACGTTTCCG | 6615 | VLKGTFP | 8282 | 101.652 |
| 1637 | TCGTTCGCCGAAATAACGACT | 6616 | SFAEITT | 8283 | 101.651 |
| 1638 | CCGTTAAACGGCCGCGTAACC | 6617 | PLNGRVT | 8284 | 101.642 |
| 1639 | TCCGAACGCCCCCAATCGTCA | 6618 | SERPQSS | 8285 | 101.579 |
| 1640 | GCTCAGCTTCAGGATTCGGTG | 6619 | AQLQDSV | 8286 | 101.568 |
| 1641 | CCCAACCGTGTAACAGCACCC | 6620 | PNRVTAP | 8287 | 101.5542 |
| 1642 | GCGCTTATTGTTTCGAGTATG | 6621 | ALIVSSM | 8288 | 101.54 |
| 1643 | GCGCATGGTGCTTTTCCGGTT | 6622 | AHGAFPV | 8289 | 101.495 |
| 1644 | GAGGCTTATCAGACTGAGAAG | 6623 | EAYQTEK | 8290 | 101.49 |
| 1645 | GCTGCGGCTTCGCCTTTGGCT | 6624 | AAASPLA | 8291 | 101.484 |
| 1646 | CCCCAAGCCACTCTCAACAAC | 6625 | PQATLNN | 8292 | 101.432 |
| 1647 | ACGAGGGGTGATATGGAGTTT | 6626 | TRGDMEF | 8293 | 101.424 |
| 1648 | AGCAACCTAGGCGAAGCATCT | 6627 | SNLGEAS | 8294 | 101.423 |
| 1649 | GGAATCACCGGAAGCCCCGGC | 6628 | GITGSPG | 8295 | 101.42 |
| 1650 | GGGTTTGAGACGAGTAGTCCT | 6629 | GFETSSP | 8296 | 101.369 |
| 1651 | CCCGCGAGAAGCGACGCCCTT | 6630 | PARSDAL | 8297 | 101.359 |
| 1652 | CATGCTAATTATGTTGAGGTG | 6631 | HANYVEV | 8298 | 101.345 |
| 1653 | GTGACTCGTAGTACGAAGGAG | 6632 | VTRSTKE | 8299 | 101.32381 |
| 1654 | GATGTTGCGTTGAGGTCGAAT | 6633 | DVALRSN | 8300 | 101.254 |
| 1655 | GAGTCTGATTTGCGTCAGCGG | 6634 | ESDLRQR | 8301 | 101.225 |
| 1656 | CCGTTACTCGCAGCGAACCCG | 6635 | PLLAANP | 8302 | 101.207 |
| 1657 | ATAAACGCCGCGCACAGGCCC | 6636 | INAAHRP | 8303 | 101.163 |
| 1658 | GCTCGGAGAGACGTAAACTCG | 6637 | ARRDVNS | 8304 | 101.15 |
| 1659 | AGTATGGATAAGGTGGAGAAG | 6638 | SMDKVEK | 8305 | 101.144 |
| 1660 | AACGTCAGCGCACGGGAAACA | 6639 | NVSARET | 8306 | 101.113 |
| 1661 | CTGACGACGGCTGGTATGTGG | 6640 | LTTAGMW | 8307 | 100.9605 |
| 1662 | GCGCGGGCAGAAGGGGTCTTC | 6641 | ARAEGVF | 8308 | 100.9325 |
| 1663 | CCGAGTGATCATATGCGGACT | 6642 | PSDHMRT | 8309 | 100.8849 |
| 1664 | AGTAGGACGGTTATTTTGTCG | 6643 | SRTVILS | 8310 | 100.8697 |
| 1665 | CAGAGTAATGCTGCTGAGGGT | 6644 | QSNAAEG | 8311 | 100.8152 |
| 1666 | TGGACCGAAACGGCCGCTCAC | 6645 | WTETAAH | 8312 | 100.7753 |
| 1667 | AAGGAGAATCAGCTTAGTAAG | 6646 | KENQLSK | 8313 | 100.7556 |

TABLE 4

RGD Motifs from expression by a CK8 promoter

| Rank | Sequence | SEQ ID NO: |
|---|---|---|
| 1 | RGDLSTP | 13 |
| 2 | RGDLNQY | 14 |
| 3 | RGDLTTP | 15 |
| 4 | RGDATEL | 16 |
| 5 | RGDQLYH | 17 |
| 6 | RGDLSTP | 18 |
| 7 | RGDVAAK | 19 |
| 8 | RGDLTTP | 20 |
| 9 | RGDLNQY | 21 |
| 10 | RGDTMSK | 22 |
| 11 | RGDVAAK | 23 |
| 12 | RGDTMSK | 24 |
| 13 | RGDATEL | 25 |

TABLE 5

RGD Motifs from expression by MHCK7 promoter

| Rank | Sequence | SEQ ID NO: |
|---|---|---|
| 1 | RGDLTTP | 26 |
| 2 | RGDLNQY | 27 |
| 3 | RGDLSTP | 28 |
| 4 | RGDQLYH | 29 |
| 5 | RGDTMSK | 30 |
| 6 | RGDATEL | 31 |
| 7 | RGDLSTP | 32 |
| 8 | RGDMINT | 33 |
| 9 | RGDLNQY | 34 |
| 10 | RGDTMSK | 35 |
| 11 | RGDLTTP | 36 |
| 12 | RGDLNDS | 37 |

TABLE 6

RGD Motifs from expression by MHCK7 and CK8 combined.

| Rank | Sequence | SEQ ID NO: |
|---|---|---|
| 1 | RGDLSTP | 38 |
| 2 | RGDLSTP | 39 |
| 3 | RGDLTTP | 40 |
| 4 | RGDLNQY | 41 |
| 5 | RGDQLYH | 42 |
| 6 | RGDATEL | 43 |
| 7 | RGDTMSK | 44 |
| 8 | RGDLNQY | 45 |
| 9 | RGDLTTP | 46 |
| 10 | RGDMINT | 47 |
| 11 | RGDTMSK | 48 |
| 12 | RGDTMNY | 49 |
| 13 | RGDATEL | 50 |

In some embodiments, the n-mer motif is or includes an "RGD" motif. An "RGD" motif refers to n-mer motifs having the presence of the amino acids R, G, D and as the three consecutive amino acids in that order of the n-mer motif. In some embodiments, the RGD motif can have the general formula $X_m RGDX_n$, where m can be 0-4 amino acids, n can be 0-15 amino acids, and where X is any amino acid, where each amino acid present can each be independently selected from the others and can be selected from the group of any amino acid. It will be appreciated that when m=0 or n=0, that this means that there are no amino acids preceding the "RGD" in the RGD motif and/or there are no amino acids following the "RGD" in the RGD motif. In some embodiments, when m=0, RGD is the first three amino acids of the RGD motif. In some embodiments, when n=0, RGD is the last three amino acids of the RGD motif. In some embodiments, where m=0 and n=0, the RGD motif contains only the amino acids RGD. Exemplary RGD motifs are shown in e.g. Tables 1-6 and 8-9.

In some exemplary embodiments, the RGD motif is $X_1RGDX_2$ (SEQ ID NO: 9100), $X_1RGDX_2X_3$ (SEQ ID NO: 9101), $X_1RGDX_2X_3X_4$ (SEQ ID NO: 9102), $X_1RGDX_2X_3X_4X_5$ (SEQ ID NO: 9103), $X_1RGDX_2X_3X_4X_5X_6$ (SEQ ID NO: 9104), $X_1RGDX_2X_3X_4X_5X_6X_7$ (SEQ ID NO: 9105) $X_1RGDX_2X_3X_4X_5X_6X_7X_8$ (SEQ ID NO: 9106), $X_1RGDX_2X_3X_4X_5X_6X_7X_8X_9$ (SEQ ID NO: 9107), $X_1RGDX_2X_3X_4X_5X_6X_7X_8X_9X_{10}$ (SEQ ID NO: 9108), $X_1RGDX_2X_3X_4X_5X_6X_7X_8X_9X_{10}X_{11}$ (SEQ ID NO: 9109), or $X_1RGDX_2X_3X_4X_5X_6X_7X_8X_9X_{10}X_{11}X_{12}$ (SEQ ID NO: 9110).

In some exemplary embodiments, the RGD motif is $X_1X_2RGDX_3$ (SEQ ID NO: 9111), $X_1X_2RGDX_3X_4$ (SEQ ID NO: 9112), $X_1X_2RGDX_3X_4X_5$ (SEQ ID NO: 9113), $X_1X_2RGDX_3X_4X_5X_6$ (SEQ ID NO: 9114), $X_1X_2RGDX_3X_4X_5X_6X_7$ (SEQ ID NO: 9115), $X_1X_2RGDX_3X_4X_5X_6X_7X_8$ (SEQ ID NO: 9116), $X_1X_2RGDX_3X_4X_5X_6X_7X_8X_9$ (SEQ ID NO: 9117), $X_1X_2RGDX_3X_4X_5X_6X_7X_8X_9X_{10}$ (SEQ ID NO: 9118), $X_1X_2RGDX_3X_4X_5X_6X_7X_8X_9X_{10}X_{11}$ (SEQ ID NO: 9119), or $X_1X_2RGDX_3X_4X_5X_6X_7X_8X_9X_{10}X_{11}X_{12}$ (SEQ ID NO: 9120).

In some exemplary embodiments, the RGD motif is $X_1X_2X_3RGDX_4$ (SEQ ID NO: 9121), $X_1X_2X_3RGDX_4X_5$ (SEQ ID NO: 9122), $X_1X_2X_3RGDX_4X_5X_6$ (SEQ ID NO: 9123), $X_1X_2X_3RGDX_4X_5X_6X_7$ (SEQ ID NO: 9124), $X_1X_2X_3RGDX_4X_5X_6X_7X_8$ (SEQ ID NO: 9125), $X_1X_2X_3RGDX_4X_5X_6X_7X_8X_9$ (SEQ ID NO: 9126), $X_1X_2X_3RGDX_4X_5X_6X_7X_8X_9X_{10}$ (SEQ ID NO: 9127), ID NO: 9128), or $X_1X_2X_3RGDX_4X_5X_6X_7X_8X_9X_{10}X_{11}X_{12}$ (SEQ ID NO: 9129).

In some exemplary embodiments, the RGD motif is $X_1X_2X_3X_4RGDX_5$ (SEQ ID NO: 9130), $X_1X_2X_3X_4RGDX_5X_6$ (SEQ ID NO: 9131), $X_1X_2X_3X_4RGDX_6X_6X_7$ (SEQ ID NO: 9132), $X_1X_2X_3X_4RGDX_5X_6X_7X_8$ (SEQ ID NO: 9133), $X_1X_2X_3X_4RGDX_5X_6X_7X_8X_9$ (SEQ ID NO: 9134), $X_1X_2X_3X_4RGDX_5X_6X_7X_8X_9X_{10}$ (SEQ ID NO: 9135), $X_1X_2X_3X_4RGDX_5X_6X_7X_8X_9X_{10}X_{11}$ (SEQ ID NO: 9136), or $X_1X_2X_3X_4RGDX_5X_6X_7X_8X_9X_{10}X_{11}X_{12}$ (SEQ ID NO: 9137).

In some embodiments, the RGD motif has the amino acids RGD as the first three consecutive amino acids of the n-mer motif (i.e. m=0). In some exemplary embodiments, the n-mer can have a sequence of RGD or $RGDX_n$, where n can be 1-15 amino acids and X can be any amino acid, where each amino acid present can each be independently selected from the others and can be selected from the group of any amino acid. In some embodiments, the n-mer motif can be RGD (3-mer), $RGDX_1$ (4-mer), $RGDX_1X_2$ (5-mer) (SEQ ID NO: 2), $RGDX_1X_2X_3$ (6-mer) (SEQ ID NO: 3), $RGDX_1X_2X_3X_4$ (7 mer) (SEQ ID NO: 4), $RGDX_1X_2X_3X_4X_5$ (8 mer) (SEQ ID NO: 5), $RGDX_1X_2X_3X_4X_5X_6$ (9-mer) (SEQ ID NO: 6), $RGD_1X_2X_3X_4X_5X_6X_7$ (10-mer) (SEQ ID NO: 7), $RGD_1X_2X_3X_4X_5X_6X_7X_8$ (11-mer) (SEQ ID NO: 8), $RGDX_1X_2X_3X_4X_5X_6X_7X_8X_9$ (12-mer) (SEQ ID NO: 9), $RGDX_1X_2X_3X_4X_5X_6X_7X_8X_9X_{10}$ (13-mer) (SEQ ID NO: 10), $RGDX_1X_2X_3X_4X_5X_6X_7X_8X_9X_{10}X_{11}$ (14-mer) (SEQ ID NO: 11), or $RGDX_1X_2X_3X_4X_5X_6X_7X_8X_9X_{10}X_{11}X_{12}$ (15-mer) (SEQ ID NO: 12), where $X_1, X_2, X_3, X_4, X_5, X_6, X_7, X_8, X_9, X_{10}, X_{11}, X_{12}$ are each be independently selected from any amino acid. In some embodiments, $X_1$ is L, T, A, M, V, Q, or M. In some embodiments, $X_2$ is T, M, S, N, L, A, or I. In some embodiments, $X_3$ is T, E, N, O, S, Q, Y, A, or D. In some embodiments, $X_4$ is P, Y, K, L, H, T, or S. In some embodiments, n-mer motifs including the RGD motif is included in a muscle-specific engineered AAV capsids.

In some embodiments, the n-mer motif can be in any one of Tables 1-6. In some embodiments, the n-mer motif in any of Tables 1-6 and 8-9 can be included in a muscle specific engineered capsid.

In some embodiments, the n-mer motif can be in any one of Tables 4-6. In some embodiments, the n-mer motif in any of Tables 4-6 and 8-9 can be included in a muscle specific engineered capsid.

The muscle-specific targeting moiety can be coupled to or otherwise associated with a cargo. In some embodiments, one or more muscle-specific targeting moieties described herein is directly attached to the cargo. In some embodiments, one or more muscle-specific targeting moieties described herein is indirectly coupled to the cargo, such as via a linker molecule. In some embodiments, one or more one or more muscle-specific targeting moieties described herein is coupled to associated with a polypeptide or other particle that is coupled to, attached to, encapsulates, and/or contains a cargo.

Exemplary particles include, without limitation, viral particles (e.g. viral capsids, which is inclusive of bacteriophage capsids), polysomes, liposomes, nanoparticles, microparticles, exosomes, micelles, and the like. The term "nanoparticle" as used herein includes a nanoscale deposit of a homogenous or heterogeneous material. Nanoparticles may be regular or irregular in shape and may be formed from a plurality of co-deposited particles that form a composite nanoscale particle. Nanoparticles may be generally spherical in shape or have a composite shape formed from a plurality of co-deposited generally spherical particles. Exemplary shapes for the nanoparticles include, but are not limited to, spherical, rod, elliptical, cylindrical, disc, and the like. In some embodiments, the nanoparticles have a substantially spherical shape.

As used herein, the term "specific" when used in relation to described an interaction between two moieties, refers to non-covalent physical association of a first and a second moiety wherein the association between the first and second moieties is at least 2 times as strong, at least 5 times as strong as, at least 10 times as strong as, at least 50 times as strong as, at least 100 times as strong as, or stronger than the association of either moiety with most or all other moieties present in the environment in which binding occurs. Binding of two or more entities may be considered specific if the equilibrium dissociation constant, Kd, is $10^{-3}$ M or less, $10^{-4}$ M or less, $10^{-5}$ M or less, $10^{-6}$ M or less, $10^{-7}$ M or less, $10^{-8}$ M or less, $10^{-9}$ M or less, $10^{-10}$ M or less, $10^{-11}$ M or less, or $10^{-12}$ M or less under the conditions employed, e.g., under physiological conditions such as those inside a cell or consistent with cell survival. In some embodiments, specific binding can be accomplished by a plurality of weaker interactions (e.g., a plurality of individual interactions, wherein each individual interaction is characterized by a Kd of greater than $10^{-3}$ M). In some embodiments, specific binding, which can be referred to as "molecular recognition," is a saturable binding interaction between two entities that is dependent on complementary orientation of functional groups on each entity. Examples of specific interactions include primer-polynucleotide interaction, aptamer-aptamer target interactions, antibody-antigen interactions, avidin-biotin interactions, ligand-receptor interactions, metal-chelate interactions, hybridization between complementary nucleic acids, etc.

In some embodiments, in addition to the one or more n-mer motifs the targeting moiety can include a polypeptide, a polynucleotide, a lipid, a polymer, a sugar, or a combination thereof.

Engineered Muscle Targeting Viral Capsids

In some embodiments, the muscle engineered muscle-specific targeting moiety is incorporated into a viral capsid protein, which can in turn be incorporated into an engineered viral capsid of an engineered virus particle, thus providing a muscle-specific virus particle. The muscle-specific engineered virus particle can be useful for delivering a cargo to muscle cells. In some embodiments, the targeting moiety is incorporated into a viral protein, such as a capsid protein, including but not limited to lentiviral, adenoviral, AAV, bacteriophage, retroviral proteins. In some embodiments, one or more n-mer motifs (such as an RGD or non-RGD n-mer motif) is located between two amino acids of the viral protein such that one or more of the one or more n-mer motifs are external (i.e. is presented on the surface of) to a viral capsid.

In some embodiments, the composition containing one or more of the muscle-specific targeting moieties described herein has increased muscle cell potency, muscle cell specificity, reduced immunogenicity, or any combination thereof.

Cargos include any molecule that is capable of being coupled to or associated with the muscle-specific targeting moieties described herein. Cargos include, without limitation, nucleotides, oligonucleotides, polynucleotides, amino acids, peptides, polypeptides, riboproteins, lipids, sugars, pharmaceutically active agents (e.g. drugs, imaging and other diagnostic agents, and the like), chemical compounds, and combinations thereof. In some embodiments, the cargo is or includes, DNA, RNA, amino acids, peptide(s), polypeptide(s), antibody (ies), aptamer(s), ribozyme(s), guide sequence(s) for ribozymes that inhibit translation or transcription of essential tumor proteins and genes, hormone(s), immunomodulator(s), antipyretic(s), anxiolytic(s), antipsychotic(s), analgesic(s), antispasmodic(s), anti-inflammatory (ries), anti-histamine(s), anti-infective(s), radiation sensitizer(s), chemotherapeutic(s), radioactive compound(s), imaging agent(s), genetic modifying agent(s), and combinations thereof.

In some embodiments, the cargo is capable of treating or preventing a muscle disease or disorder. In some embodiments, the muscle disease or disorder is (a) an auto immune disease; (b) a cancer; (c) a muscular dystrophy; (d) a neuro-muscular disease; (e) a sugar or glycogen storage disease; (f) an expanded repeat disease; (g) a dominant negative disease; (h) a cardiomyopathy; (i) a viral disease; (j) a progeroid disease; or (k) any combination thereof. In some embodiments, the expanded repeat disease is Huntington's disease, a Myotonic Dystrophy, or Facioscapulohumeral muscular dystrophy (FSHD). In some embodiments, the muscular dystrophy is Duchene muscular dystrophy, Becker Muscular dystrophy, a Limb-Girdle muscular dystrophy, an Emery Dreifuss muscular dystrophy, a myotonic dystrophy, or FSHD. In some embodiments, the myotonic dystrophy is Type 1 or Type 2. In some embodiments, the sugar or glycogen storage disease is a MPS type III disease or Pompe disease. In some embodiments, the MPS type III disease, is MPS Type IIIA, IIIB, IIIC, or IIID. In some embodiments, the neuro-muscular disease is Charcot-Marie-Tooth disease or Friedreich's Ataxia.

In some embodiments, the cargo is a morpholino, a peptide-linked morpholino, an antisense oligonucleotide, a PMO, a therapeutic transgene, a polynucleotide encoding a therapeutic polypeptide or peptide, a PPMO, one or more peptides, one or more polynucleotides encoding a CRISPR-Cas protein, a guide RNA, or both, a ribonucleoprotein, wherein the ribonucleoprotein comprises a CRISPR-Cas system molecule, a therapeutic transgene RNA, or other gene modifying or therapeutic RNA and/or protein, or any combination thereof.

In some embodiments, the cargo is capable of inducing exon skipping in a gene.

In some embodiments, the cargo is capable of inducing exon skipping in a dystrophin gene.

In some embodiments, the cargo is a mini- or micro-dystrophin gene. In some embodiments, the mini- or micro-dystrophin gene comprises spectrin-like repeats 1, 2, 3, 16, 17, and 24, and optionally an nNOS domain.

Engineered Muscle Targeting AAV Capsids and AAVs

In some embodiments, the engineered muscle-specific targeting moiety is incorporated an adeno-associated virus (AAV) capsid. Described herein are various embodiments of engineered AAV capsids that can be engineered to confer cell-specific tropism to an engineered AAV particle. The engineered capsids can be included in an engineered virus particle and can confer cell-specific tropism, reduced immunogenicity, or both to the engineered AAV particle. The engineered AAV capsids described herein can include one or more engineered AAV capsid proteins described herein. In some embodiments, the AAV capsid protein comprises one or more n-mer motifs. In some embodiments, one or more of the n-mer motifs contains or is an RGD motif or a non-RGD n-mer motif. Such motifs are defined and described in greater detail elsewhere herein. In some embodiments, one or more of the one or more n-mer motifs incorporated into one or more AAV capsid proteins can confer muscle specificity to an AAV virus particle having the engineered capsid with the n-mer motif(s).

The engineered AAV capsid and/or capsid proteins can be encoded by one or more engineered AAV capsid polynucleotides. In some embodiments, an engineered AAV capsid polynucleotide can include a 3' polyadenylation signal. The polyadenylation signal can be an SV40 polyadenylation signal.

The engineered AAV capsids can be variants of wild-type AAV capsids. In some embodiments, the wild-type AAV capsids can be composed of VP1, VP2, VP3 capsid proteins or a combination thereof. In other words, the engineered AAV capsids can include one or more variants of a wild-type VP1, wild-type VP2, and/or wild-type VP3 capsid proteins. In some embodiments, the serotype of the reference wild-type AAV capsid can be AAV1, AAV2, AAV3, AAV4, AAV5, AAV6, AAV7, AAV8, AAV rh.74, or AAV rh.10, or any combination thereof. In some embodiments, the serotype of the wild-type AAV capsid can be AAV-9. The engineered AAV capsids can have a different tropism than that of the reference wild-type AAV capsid.

The engineered AAV capsid can contain 1-60 engineered capsid proteins. In some embodiments, the engineered AAV capsids can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, to/or 60 engineered capsid proteins. In some embodiments, the engineered AAV capsid can contain 0-59 wild-type AAV capsid proteins. In some embodiments, the engineered AAV capsid can contain 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, to/or 59 wild-type AAV capsid proteins.

In some embodiments, the engineered AAV capsid protein has an n-mer amino acid motif, where n can be at least 3 amino acids. In some embodiments, n can be 3, 4, 5, 6, 7, 8, 9, 10, 11, 12, 13, 14, or 15 amino acids. In some embodiments, the engineered AAV capsid can have a 6-mer or 7-mer amino acid motif. In some embodiments, the n-mer amino acid motif is inserted between two amino acids in the wild-type viral protein (VP) (or capsid protein). In some embodiments, the n-mer motif can be inserted between two amino acids in a variable amino acid region in an AAV capsid protein. The core of each wild-type AAV viral protein contains an eight-stranded beta-barrel motif (betaB to betaI) and an alpha-helix (alphaA) that are conserved in autonomous parvovirus capsids (see e.g. DiMattia et al. 2012. J. Virol. 86(12): 6947-6958). Structural variable regions (VRs) occur in the surface loops that connect the beta-strands, which cluster to produce local variations in the capsid surface. AAVs have 12 variable regions (also referred to as hypervariable regions) (see e.g. Weitzman and Linden. 2011. "Adeno-Associated Virus Biology." In Snyder, R. O., Moullier, P. (eds.) Totowa, NJ: Humana Press). In some embodiments, one or more n-mer motifs are inserted between two amino acids in one or more of the 12 variable regions in the wild-type AAV capsid proteins. In some embodiments, the one or more n-mer motifs are each inserted between two amino acids in VR-I, VR-II, VR-III, VR-IV, VR-V, VR-VI, VR-VII, VR-III, VR-IX, VR-X, VR-XI, VR-XII, or a combination thereof. In some embodiments, the n-mer is be inserted between two amino acids in the VR-III of a capsid protein. In some embodiments, the engineered capsid can have an n-mer inserted between any two contiguous amino acids between amino acids 262 and 269, between any two contiguous amino acids between amino acids 327 and 332, between any two contiguous amino acids between amino acids 382 and 386, between any two contiguous amino acids between amino acids 452 and 460, between any two contiguous amino acids between amino acids 488 and 505, between any two contiguous amino acids between amino acids 545 and 558, between any two contiguous amino acids between amino acids 581 and 593, between any two contiguous amino acids between amino acids 704 and 714 of an AAV9 viral protein. In some embodiments, the engineered capsid can have an n-mer inserted between amino acids 588 and 589 of an AAV9 viral protein. In some embodiments, the engineered capsid can have a 7-mer motif inserted between amino acids 588 and 589 of an AAV9 viral protein. SEQ ID NO: 1 is a reference AAV9 capsid sequence for at least referencing the insertion sites discussed above. It will be appreciated that n-mers can be inserted in analogous positions in AAV viral proteins of other serotypes. In some embodiments as previously discussed, the n-mer(s) can be inserted between any two contiguous amino acids within the AAV viral protein and in some embodiments the insertion is made in a variable region.

AAV9 capsid reference sequence

SEQ ID NO: 1

MAADGYLPDWLEDNLSEGIREWWALKPGAPQPKANQQHQDNARGLVLPGY

KYLGPGNGLDKGEPVNAADAAALEHDKAYDQQLKAGDNPYLKYNHADAEF

QERLKEDTSFGGNLGRAVFQAKKRLLEPLGLVEEAAKTAPGKKRPVEQSP

QEPDSSAGIGKSGAQPAKKRLNFGQTGDTESVPDPQPIGEPPAAPSGVGS

LTMASGGGAPVADNNEGADGVGSSSGNWHCDSQWLGDRVITTSTRTWALP

TYNNHLYKQISNSTSGGSSNDNAYFGYSTPWGYFDFNRFHCHFSPRDWQR

LINNNWGFRPKRLNFKLFNIQVKEVTDNNGVKTIANNLTSTVQVFTDSDY

QLPYVLGSAHEGCLPPFPADVFMIPQYGYLTLNDGSQAVGRSSFYCLEYF

PSQMLRTGNNFQFSYEFENVPFHSSYAHSQSLDRLMNPLIDQYLYYLSKT

INGSGQNQQTLKFSVAGPSNMAVQGRNYIPGPSYRQQRVSTTVTQNNNSE

FAWPGASSWALNGRNSLMNPGPAMASHKEGEDRFFPLSGSLIFGKQGTGR

DNVDADKVMITNEEEIKTTNPVATESYGQVATNHQSAQAQAQTGWVQNQG

ILPGMVWQDRDVYLQGPIWAKIPHTDGNFHPSPLMGGFGMKHPPPQILIK

NTPVPADPPTAFNKDKLNSFITQYSTGQVSVEIEWELQKENSKRWNPEIQ

YTSNYYKSNNVEFAVNTEGVYSEPRPIGTRYLTRNL

In some embodiments, the n-mer motif can be any amino acid motif as shown or encoded by a nucleic acid as shown in Tables 1-3. In some embodiments, insertion of the n-mer motif in an AAV capsid can result in cell, tissue, organ, specific engineered AAV capsids. In some embodiments, the engineered capsid has a specificity (or tropism) for muscle cells. In some embodiments, the engineered capsid can have a specificity for bone tissue and/or cells, lung tissue and/or cells, liver tissues and/or cells, bladder tissue and/or cells, kidney tissue and/or cells, cardiac tissue and/or cells, skeletal muscle tissue and/or cells, smooth muscle and/or cells, neuronal tissue and/or cells, intestinal tissue and/or cells, pancreases tissue and/or cells, adrenal gland tissue and/or cells, brain tissue and/or cells, tendon tissues or cells, skin tissues and/or cells, spleen tissue and/or cells, eye tissue and/or cells, blood cells, synovial fluid cells, immune cells (including specificity for particular types of immune cells), and combinations thereof.

In some embodiments, the AAV capsids are muscle-specific. In some embodiments, muscle-specificity of the engineered AAV capsid is conferred by a muscle specific n-mer motif incorporated in the engineered AAV capsid. While not intending to be bound by theory, it is believed that the n-mer motif confers a 3D structure to or within a domain or region of the engineered AAV capsid such that the interaction of an engineered AAV containing said engineered AAV capsid has increased or improved interactions (e.g. increased affinity) with a cell surface receptor and/or other molecule on the surface of a muscle cell. In some embodiments, the cell surface receptor is AAV receptor (AAVR). In some embodiments, the cell surface receptor is a muscle cell specific AAV receptor. In some embodiments, a muscle specific engineered AAV containing the muscle-specific capsid can have an increased transduction rate, efficiency, amount, or a combination thereof in a muscle cell as compared to other cells types and/or other AAVs that do not contain a muscle-specific engineered AAV capsid as described herein.

Methods of Generating Muscle Specific Targeting Moieties

Figure 6:
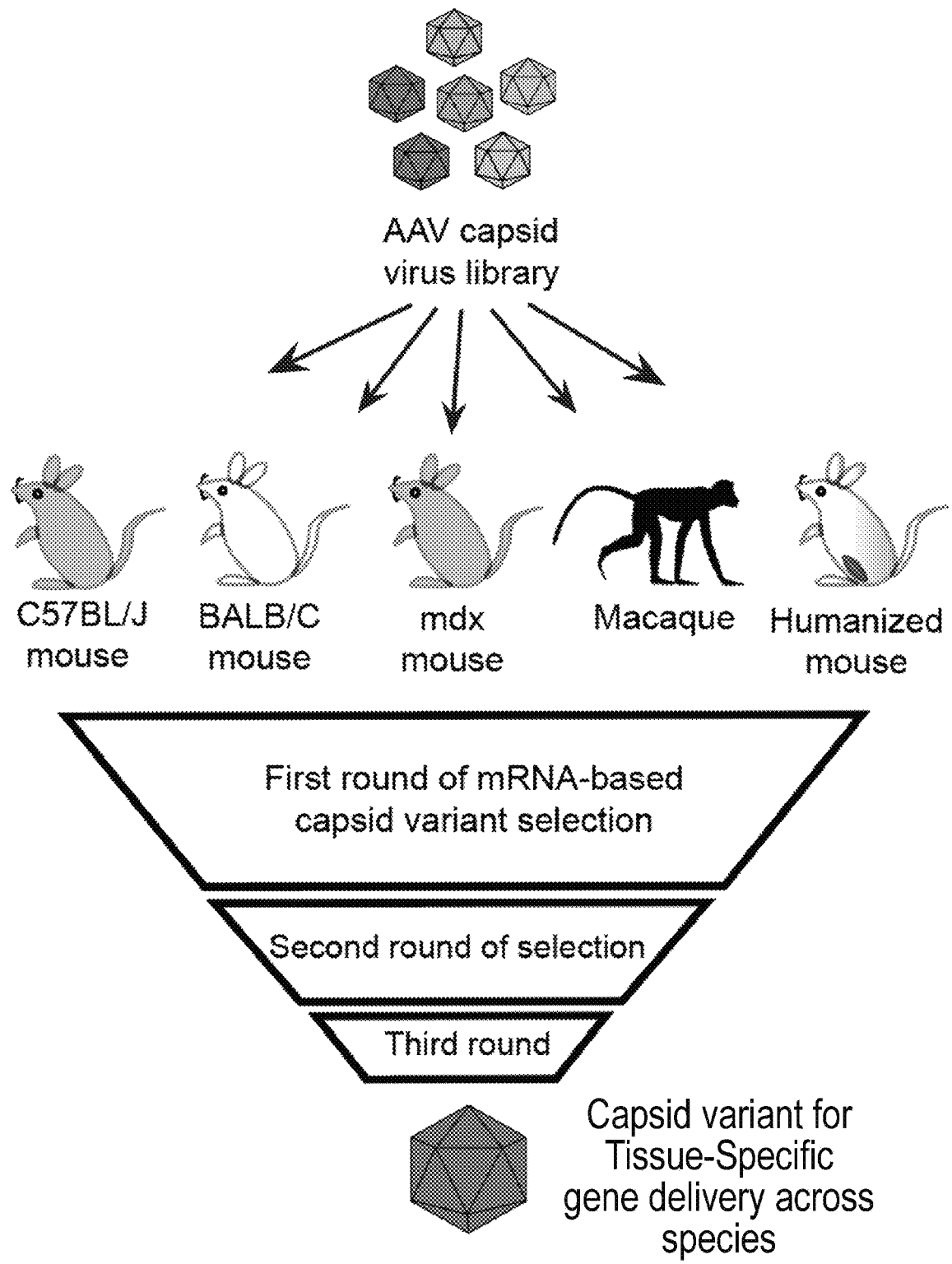
FIG. 6 shows a schematic demonstrating embodiments of a method of producing and selecting capsid variants for tissue-specific gene delivery across species.
Figure 7:
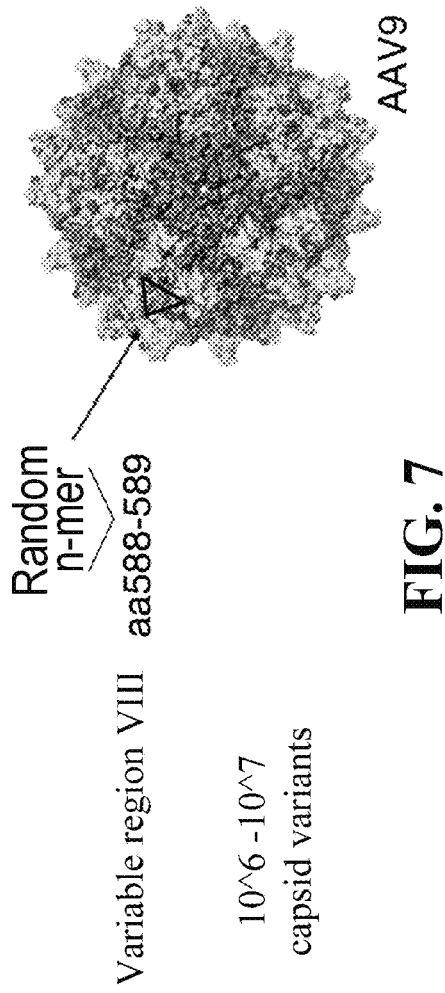
FIG. 7 shows a schematic demonstrating embodiments of generating an AAV capsid variant library, particularly insertion of a random n-mer (n=3-15 amino acids) into a wild-type AAV, e.g. AAV9.
Figure 8:
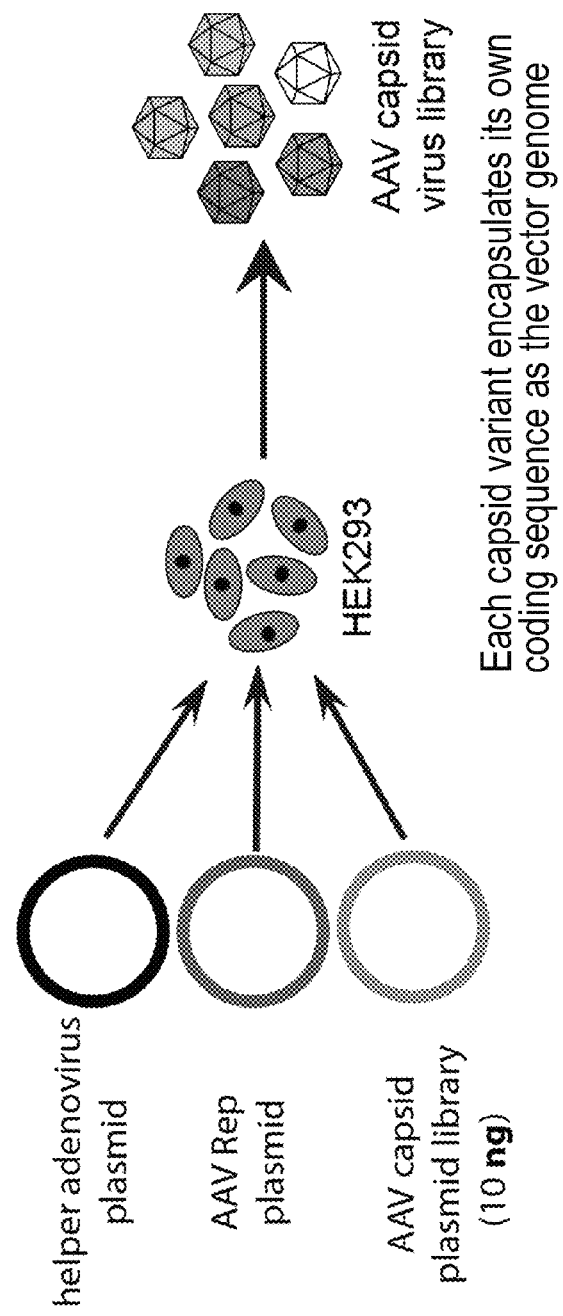
FIG. 8 shows a schematic demonstrating embodiments of generating an AAV capsid variant library, particularly variant AAV particle production. Each capsid variant encapsulates its own coding sequence as the vector genome.

Also provided herein are methods of generating engineered AAV capsids. The engineered AAV capsid variants can be variants of wild-type AAV capsids. FIGS. 6-8 can illustrate various embodiments of methods capable of generating engineered AAV capsids described herein. Generally, an AAV capsid library can be generated by expressing engineered capsid vectors each containing an engineered AAV capsid polynucleotide previously described in an appropriate AAV producer cell line. See e.g. FIG. 8. It will be appreciated that although FIG. 8 shows a helper-dependent method of AAV particle production, it will be appreciated that this can be done via a helper-free method as well. This can generate an AAV capsid library that can contain one more desired cell-specific engineered AAV capsid variant. As shown in FIG. 6 the AAV capsid library can be administered to various non-human animals for a first round of mRNA-based selection. As shown in FIG. 1, the transduction process by AAVs and related vectors can result in the production of an mRNA molecule that is reflective of the genome of the virus that transduced the cell. As is at least demonstrated in the Examples herein, mRNA based-selection can be more specific and effective to determine a virus particle capable of functionally transducing a cell because it is based on the functional product produced as opposed to just detecting the presence of a virus particle in the cell by measuring the presence of viral DNA.

After first-round administration, one or more engineered AAV virus particles having a desired capsid variant can then be used to form a filtered AAV capsid library. Desirable AAV virus particles can be identified by measuring the mRNA expression of the capsid variants and determining which variants are highly expressed in the desired cell type(s) as compared to non-desired cells type(s). Those that are highly expressed in the desired cell, tissue, and/or organ type are the desired AAV capsid variant particles. In some embodiments, the AAV capsid variant encoding polynucleotide is under control of a tissue-specific promoter that has selective activity in the desired cell, tissue, or organ.

The engineered AAV capsid variant particles identified from the first round can then be administered to various non-human animals. In some embodiments, the animals used in the second round of selection and identification are not the same as those animals used for first round selection and identification. Similar to round 1, after administration the top expressing variants in the desired cell, tissue, and/or organ type(s) can be identified by measuring viral mRNA expression in the cells. The top variants identified after round two can then be optionally barcoded and optionally pooled. In some embodiments, top variants from the second round can then be administered to a non-human primate to identify the top cell-specific variant(s), particularly if the end use for the top variant is in humans. Administration at each round can be systemic.

In some embodiments, the method of generating an AAV capsid variant can include the steps of: (a) expressing a vector system described herein that contains an engineered AAV capsid polynucleotide in a cell to produce engineered AAV virus particle capsid variants; (b) harvesting the engineered AAV virus particle capsid variants produced in step (a); (c) administering engineered AAV virus particle capsid variants to one or more first subjects, wherein the engineered AAV virus particle capsid variants are produced by expressing an engineered AAV capsid variant vector or system thereof in a cell and harvesting the engineered AAV virus particle capsid variants produced by the cell; and (d) identifying one or more engineered AAV capsid variants produced at a significantly high level by one or more specific cells or specific cell types in the one or more first subjects. In this context, "significantly high" can refer to a titer that can range from between about $2\times10^{11}$ to about $6\times10^{12}$ vector genomes per 15 cm dish.

The method can further include the steps of: (e) administering some or all engineered AAV virus particle capsid variants identified in step (d) to one or more second subjects; and (f) identifying one or more engineered AAV virus particle capsid variants produced at a significantly high level in one or more specific cells or specific cell types in the one or more second subjects. The cell in step (a) can be a prokaryotic cell or a eukaryotic cell. In some embodiments, the administration in step (c), step (e), or both is systemic. In some embodiments, one or more first subjects, one or more second subjects, or both, are non-human mammals. In some embodiments, one or more first subjects, one or more second subjects, or both, are each independently selected from the group consisting of: a wild-type non-human mammal, a humanized non-human mammal, a disease-specific non-human mammal model, and a non-human primate.

Other methods and details of developing muscle-specific targeting moieties are described in, for example, U.S. Provisional Application Ser. Nos. 62/899,453, 62/916,207, 63/018,454, 63/055,252, and 62/916,221 and International Application No. PCT/US20/50534.

Engineered Muscle-Specific Targeting Moiety Encoding Polynucleotides, Vectors, and Vector Systems Described herein are polynucleotides that encode the one or more muscle-specific engineered targeting moieties and vectors and/or vector systems thereof. In some embodiments, the encoding polynucleotides, vectors, and/or vector systems can be used to express and/or produce the engineered muscle-specific targeting moieties, couple the engineered muscle-specific targeting moiety to one or more other polypeptides, and/or produce particles, such as viral particles that optionally contain a cargo, that include one or more engineered muscle-specific targeting moieties described herein. The term "engineered muscle-specific targeting moiety polynucleotide" as used herein refers to a polynucleotide that encodes an engineered muscle-specific targeting moiety. As used herein, the term "encode" refers to principle that DNA can be transcribed into RNA, which can then be translated into amino acid sequences that can form proteins. Thus, polynucleotides said to encode a subsequent polynucleotide (such as an RNA species) or proteins can also be referred to as encoding polynucleotides and refer to DNA molecules that are subsequently transcribed and/or translated as well as RNA molecules that are translated.

Also provided herein are vectors and vector systems that can contain one or more of the engineered muscle-specific targeting moiety polynucleotides (including, but not limited to, engineered AAV capsid polynucleotides) described herein. As used in this context, engineered AAV capsid polynucleotides refers to any one or more of the polynucleotides described herein capable of encoding an engineered AAV capsid as described elsewhere herein and/or polynucleotide(s) capable of encoding one or more engineered AAV capsid proteins described elsewhere herein. Further, where the vector includes an engineered muscle-specific targeting moiety polynucleotide (including, but not limited to, an engineered AAV capsid polynucleotide) described herein, the vector can also be referred to and considered an engineered vector or system thereof although not specifically noted as such. In embodiments, the vector can contain one or more polynucleotides encoding one or more elements of an engineered viral capsid, such as an AAV capsid, described herein. The vectors and systems thereof can be useful in producing bacterial, fungal, yeast, plant cells, animal cells, and transgenic animals that can express a muscle-specific targeting moiety or composition containing a muscle-specific targeting moiety described herein. In some embodiments, the vectors and systems thereof can be useful in producing bacterial cells, fungal cells, yeast cells, plant cells, animal cells, or transgenic organisms (e.g. plants, animals) that can express the one or more components of the engineered AAV capsid described herein. Within the scope of this disclosure are vectors containing one or more of the polynucleotide sequences described herein. One or more of the polynucleotides that are part of the engineered AAV capsid and system thereof described herein can be included in a vector or vector system.

The vectors and/or vector systems can be used, for example, to express one or more of the engineered muscle-specific targeting moiety polynucleotides (including, but not limited to, engineered AAV capsid polynucleotides) in a cell, such as a producer cell, to produce engineered viral particles containing an engineered viral capsid (e.g. an AAV containing an engineered AAV capsid) described elsewhere herein. Other uses for the vectors and vector systems described herein are also within the scope of this disclosure. In general, and throughout this specification, the term is a tool that allows or facilitates the transfer of an entity from one environment to another. In some contexts which will be appreciated by those of ordinary skill in the art, "vector" can be a term of art to refer to a nucleic acid molecule capable of transporting another nucleic acid to which it has been linked. A vector can be a replicon, such as a plasmid, phage, or cosmid, into which another DNA segment may be inserted so as to bring about the replication of the inserted segment. Generally, a vector is capable of replication when associated with the proper control elements.

Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can be composed of a nucleic acid (e.g. a polynucleotide) of the invention in a form suitable for expression of the nucleic acid in a host cell, which means that the recombinant expression vectors include one or more regulatory elements, which can be selected on the basis of the host cells to be used for expression, that is operatively-linked to the nucleic acid sequence to be expressed. Within a recombinant expression vector, "operably linked" and "operatively-linked" are used interchangeably herein and further defined elsewhere herein. In the context of a vector, the term "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include adeno-associated viruses, and types of such vectors can also be selected for targeting particular types of cells, such as those engineered AAV vectors containing an engineered AAV capsid polynucleotide with a desired cell-specific tropism, such as a muscle-specific tropism. These and other embodiments of the vectors and vector systems are described elsewhere herein.

In some embodiments, the vector can be a bicistronic vector. In some embodiments, a bicistronic vector can be used for expressing one or more engineered muscle-specific targeting moiety polynucleotides (including, but not limited to, engineered AAV capsid polynucleotides) system described herein. In some embodiments, expression of an engineered muscle-specific targeting moiety polynucleotides (including, but not limited to, engineered AAV capsid polynucleotides) described herein can be driven by the suitable constitutive or tissue specific promoter. Such embodiments can be advantageous for generating muscle-specific targeting moieties, which are described in greater detail elsewhere herein. Where the element of the engineered AAV capsid system is an RNA, its expression can be driven by a Pol III promoter, such as a U6 promoter. In some embodiments, the two are combined.

Cell-Based Vector Amplification and Expression

Vectors can be designed for expression of one or more engineered muscle-specific targeting moiety polynucleotides (including, but not limited to, engineered AAV capsid polynucleotides) or a system including one or more engineered muscle-specific targeting moiety polynucleotides (including, but not limited to, engineered AAV capsid polynucleotides) or product thereof described herein (e.g. nucleic acid transcripts, proteins, enzymes, and combinations thereof) in a suitable host cell. In some embodiments, the suitable host cell is a prokaryotic cell. Suitable host cells include, but are not limited to, bacterial cells, yeast cells, insect cells, and mammalian cells. The vectors can be viral-based or non-viral based. In some embodiments, the suitable host cell is a eukaryotic cell. In some embodiments, the suitable host cell is a suitable bacterial cell. Suitable bacterial cells include, but are not limited to, bacterial cells from the bacteria of the species *Escherichia coli*. Many suitable strains of *E. coli* are known in the art for expression of vectors. These include, but are not limited to Pir1, Stbl2, Stbl3, Stbl4, TOP10, XL1 Blue, and XL10 Gold. In some embodiments, the host cell is a suitable insect cell. Suitable insect cells include those from *Spodoptera frugiperda*. Suitable strains of *S. frugiperda* cells include, but are not limited to, Sf9 and Sf21. In some embodiments, the host cell is a suitable yeast cell. In some embodiments, the yeast cell can be from *Saccharomyces cerevisiae*. In some embodiments, the host cell is a suitable mammalian cell. Many types of mammalian cells have been developed to express vectors. Suitable mammalian cells include, but are not limited to, HEK293, Chinese Hamster Ovary Cells (CHOs), mouse myeloma cells, HeLa, U2OS, A549, HT1080, CAD, P19, NIH 3T3, L929, N2a, MCF-7, Y79, SO-Rb50, HepG G2, DIKX-X11, J558L, Baby hamster kidney cells (BHK), and chicken embryo fibroblasts (CEFs). Suitable host cells are discussed further in Goeddel, GENE EXPRESSION TECHNOLOGY: METHODS IN ENZYMOLOGY 185, Academic Press, San Diego, Calif. (1990).

In some embodiments, the vector can be a yeast expression vector. Examples of vectors for expression in yeast *Saccharomyces cerevisiae* include pYepSec1 (Baldari, et al., 1987. EMBO J. 6:229-234), pMFa (Kuijan and Herskowitz, 1982. Cell 30:933-943), pJRY88 (Schultz et al., 1987. Gene 54:113-123), pYES2 (Invitrogen Corporation, San Diego, Calif.), and picZ (In Vitrogen Corp, San Diego, Calif.). As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors can contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2μ plasmids, yeast integrative plasmids, yeast replicative plasmids, shuttle vectors, and episomal plasmids.

In some embodiments, the vector is a baculovirus vector or expression vector and can be suitable for expression of polynucleotides and/or proteins in insect cells. Baculovirus vectors available for expression of proteins in cultured insect cells (e.g., SF9 cells) include the pAc series (Smith, et al., 1983. Mol. Cell. Biol. 3:2156-2165) and the pVL series (Lucklow and Summers, 1989. Virology 170:31-39). rAAV (recombinant Adeno-associated viral) vectors are preferably produced in insect cells, e.g., *Spodoptera frugiperda* Sf9 insect cells, grown in serum-free suspension culture. Serum-free insect cells can be purchased from commercial vendors, e.g., Sigma Aldrich (EX-CELL 405).

In some embodiments, the vector is a mammalian expression vector. In some embodiments, the mammalian expression vector is capable of expressing one or more polynucleotides and/or polypeptides in a mammalian cell. Examples of mammalian expression vectors include, but are not limited to, pCDM8 (Seed, 1987. Nature 329:840) and pMT2PC (Kaufman, et al., 1987. EMBO J. 6:187-195). The mammalian expression vector can include one or more suitable regulatory elements capable of controlling expression of the one or more polynucleotides and/or proteins in the mammalian cell. For example, commonly used promoters are derived from polyoma, adenovirus 2, cytomegalovirus, simian virus 40, and others disclosed herein and known in the art. More detail on suitable regulatory elements are described elsewhere herein.

For other suitable expression vectors and vector systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1:268-277), lymphoid-specific promoters (Calame and Eaton, 1988. *Adv. Immunol.* 43:235-275), in particular promoters of T cell receptors (Winoto and Baltimore, 1989. *EMBO J.* 8:729-733) and immunoglobulins (Baneiji, et al., 1983. *Cell* 33:729-740; Queen and Baltimore, 1983. *Cell* 33:741-748), neuron-specific promoters (e.g., the neurofilament promoter; Byrne and Ruddle, 1989. *Proc. Natl. Acad. Sci. USA* 86:5473-5477), pancreas-specific promoters (Edlund, et al., 1985. *Science* 230:912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249:374-379) and the α-fetoprotein promoter (Campes and Tilghman, 1989. *Genes Dev.* 3:537-546). With regards to these prokaryotic and eukaryotic vectors, mention is made of U.S. Pat. No. 6,750,059, the contents of which are incorporated by reference herein in their entirety. Other embodiments can utilize viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element can be operably linked to or coupled to one or more engineered muscle-specific targeting moiety polynucleotides (including, but not limited to, engineered AAV capsid polynucleotides) and/or one or more elements of a system comprising one or more engineered muscle-specific targeting moiety polynucleotides (including, but not limited to, engineered AAV capsid polynucleotides) or product thereof so as to drive expression of the one or more elements of the engineered muscle-specific targeting moiety polynucleotides (including, but not limited to, engineered AAV capsid polynucleotides) or system thereof described herein.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism.

In some embodiments, the vector can be a fusion vector or fusion expression vector. In some embodiments, fusion vectors add a number of amino acids to a protein encoded therein, such as to the amino terminus, carboxy terminus, or both of a recombinant protein. Such fusion vectors can serve one or more purposes, such as: (i) to increase expression of recombinant protein; (ii) to increase the solubility of the recombinant protein; and (iii) to aid in the purification of the recombinant protein by acting as a ligand in affinity purification. In some embodiments, expression of polynucleotides (such as non-coding polynucleotides) and proteins in prokaryotes can be carried out in *Escherichia coli* with vectors containing constitutive or inducible promoters directing the expression of either fusion or non-fusion polynucleotides and/or proteins. In some embodiments, the fusion expression vector can include a proteolytic cleavage site, which can be introduced at the junction of the fusion vector backbone or other fusion moiety and the recombinant polynucleotide or protein to enable separation of the recombinant polynucleotide or protein from the fusion vector backbone or other fusion moiety subsequent to purification of the fusion polynucleotide or protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67:31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, one or more vectors driving expression of one or more engineered muscle-specific targeting moiety polynucleotides (including, but not limited to, engineered AAV capsid polynucleotides), vector, and/or vector system thereof described herein are introduced into a host cell such that expression of one or more the engineered muscle-specific targeting moiety polynucleotides (including, but not limited to, engineered AAV capsid polynucleotides), vectors, and/or vector systems described herein direct formation of an engineered muscle-specific targeting moiety and/or compositions or engineered muscle-specific delivery systems that include one or more engineered muscle-specific targeting moieties described herein. In some embodiments, the engineered muscle-specific delivery system is a viral particle such as an engineered AAV particle that contains an engineered capsid that contains one or more engineered muscle-specific targeting moieties described elsewhere herein. For example, different elements of an engineered muscle-specific delivery system can each be operably linked to separate regulatory elements on the same or separate vectors. RNA(s) of different elements of the engineered muscle-specific delivery system described herein that can include one or more engineered muscle-specific targeting moiety can be delivered to an animal or mammal or cell thereof to produce an animal or mammal or cell thereof that constitutively, inducibly, or conditionally expresses different elements of the engineered muscle-specific delivery system described herein or contains one or more cells that incorporates and/or expresses one or more elements of the engineered muscle-specific delivery system described herein.

In some embodiments, two or more of the elements expressed from the same or different regulatory element(s) can be combined in a single vector along with one or more additional vectors providing any components of the system not included in the first vector. Engineered muscle-specific delivery system polynucleotides (including but not limited to engineered muscle-specific targeting moiety polynucleotides) that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding one or more engineered muscle-specific targeting moiety polynucleotides, embedded within one or more intron sequences (e.g., each in a different intron, two or more in at least one intron, or all in a single intron). In some embodiments, two or more engineered muscle-specific targeting moiety polynucleotides can be operably linked to and expressed from the same promoter.

Vector Features

The vectors can include additional features that can confer one or more functionalities to the vector, the polynucleotide to be delivered, a virus particle produced there from, or polypeptide expressed thereof. Such features include, but are not limited to, regulatory elements, selectable markers, molecular identifiers (e.g. molecular barcodes), stabilizing elements, and the like. It will be appreciated by those skilled in the art that the design of the expression vector and additional features included can depend on such factors as the choice of the host cell to be transformed, the level of expression desired, etc.

Regulatory Elements

In embodiments, the polynucleotides and/or vectors thereof described herein (such as the engineered muscle-specific targeting moiety polynucleotides of the present invention) can include one or more regulatory elements that can be operatively linked to the polynucleotide. The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter can direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) (see, e.g., Boshart et al, Cell, 41:521-530(1985)), the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981).

In some embodiments, the regulatory sequence can be a regulatory sequence described in U.S. Pat. No. 7,776,321, U.S. Pat. Pub. No. 2011/0027239, and PCT publication WO 2011/028929, the contents of which are incorporated by reference herein in their entirety. In some embodiments, the vector can contain a minimal promoter. In some embodiments, the minimal promoter is the Mecp2 promoter, tRNA promoter, or U6. In a further embodiment, the minimal promoter is tissue specific. In some embodiments, the length of the vector polynucleotide the minimal promoters and polynucleotide sequences is less than 4.4 Kb.

To express a polynucleotide, the vector can include one or more transcriptional and/or translational initiation regulatory sequences, e.g. promoters, that direct the transcription of the gene and/or translation of the encoded protein in a cell. In some embodiments a constitutive promoter may be employed. Suitable constitutive promoters for mammalian cells are generally known in the art and include, but are not limited to SV40, CAG, CMV, EF-1α, β-actin, RSV, and PGK. Suitable constitutive promoters for bacterial cells, yeast cells, and fungal cells are generally known in the art, such as a T-7 promoter for bacterial expression and an alcohol dehydrogenase promoter for expression in yeast.

In some embodiments, the regulatory element can be a regulated promoter. "Regulated promoter" refers to promoters that direct gene expression not constitutively, but in a temporally- and/or spatially-regulated manner, and includes tissue-specific, tissue-preferred and inducible promoters. In some embodiments, the regulated promoter is a tissue specific promoter as previously discussed elsewhere herein. Regulated promoters include conditional promoters and inducible promoters. In some embodiments, conditional promoters can be employed to direct expression of a polynucleotide in a specific cell type, under certain environmental conditions, and/or during a specific state of development. Suitable tissue specific promoters can include, but are not limited to, liver specific promoters (e.g. APOA2, SERPIN A1 (hAAT), CYP3A4, and MIR122), pancreatic cell promoters (e.g. INS, IRS2, Pdx1, Alx3, Ppy), cardiac specific promoters (e.g. Myh6 (alpha MHC), MYL2 (MLC-2v), TNI3 (cTnI), NPPA (ANF), Slc8a1 (Ncx1)), central nervous system cell promoters (SYN1, GFAP, INA, NES, MOBP, MBP, TH, FOXA2 (HNF3 beta)), skin cell specific promoters (e.g. FLG, K14, TGM3), immune cell specific promoters, (e.g. ITGAM, CD43 promoter, CD14 promoter, CD45 promoter, CD68 promoter), urogenital cell specific promoters (e.g. Pbsn, Upk2, Sbp, Fer114), endothelial cell specific promoters (e.g. ENG), pluripotent and embryonic germ layer cell specific promoters (e.g. Oct4, NANOG, Synthetic Oct4, T brachyury, NES, SOX17, FOXA2, MIR122), and muscle cell specific promoter (e.g. Desmin). Other tissue and/or cell specific promoters are discussed elsewhere herein and can be generally known in the art and are within the scope of this disclosure.

Inducible/conditional promoters can be positively inducible/conditional promoters (e.g. a promoter that activates transcription of the polynucleotide upon appropriate interaction with an activated activator, or an inducer (compound, environmental condition, or other stimulus) or a negative/conditional inducible promoter (e.g. a promoter that is repressed (e.g. bound by a repressor) until the repressor condition of the promotor is removed (e.g. inducer binds a repressor bound to the promoter stimulating release of the promoter by the repressor or removal of a chemical repressor from the promoter environment). The inducer can be a compound, environmental condition, or other stimulus. Thus, inducible/conditional promoters can be responsive to any suitable stimuli such as chemical, biological, or other molecular agents, temperature, light, and/or pH. Suitable inducible/conditional promoters include, but are not limited to, Tet-On, Tet-Off, Lac promoter, pBad, AlcA, LexA, Hsp70 promoter, Hsp90 promoter, pDawn, XVE/OlexA, GVG, and pOp/LhGR.

Where expression in a plant cell is desired, the components of the engineered AAV capsid system described herein are typically placed under control of a plant promoter, i.e. a promoter operable in plant cells. The use of different types of promoters is envisaged. In some embodiments, inclusion of a engineered AAV capsid system vector in a plant can be for AAV vector production purposes.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. Different promoters may direct the expression of a gene in different tissues or cell types, or at different stages of development, or in response to different environmental conditions. In particular embodiments, one or more of the engineered AAV capsid system components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the engineered AAV capsid system are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Examples of promoters that are inducible and that can allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc.), or light inducible systems (Phytochrome, LOV domains, or cryptochrome)., such as a Light Inducible Transcriptional Effector (LITE) that direct changes in transcriptional activity in a sequence-specific manner. The components of a light inducible system may include one or more elements of the engineered muscle-specific delivery system described herein, a light-responsive cytochrome heterodimer (e.g. from *Arabidopsis thaliana*), and a transcriptional activation/repression domain. In some embodiments, the vector can include one or more of the inducible DNA binding proteins provided in PCT publication WO 2014/018423 and US Publications, 2015/0291966, 2017/0166903, 2019/0203212, which describe e.g. embodiments of inducible DNA binding proteins and methods of use and can be adapted for use with the present invention.

In some embodiments, transient or inducible expression can be achieved by including, for example, chemical-regulated promotors, i.e. whereby the application of an exogenous chemical induces gene expression. Modulation of gene expression can also be obtained by including a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-11-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

In some embodiments, the vector or system thereof can include one or more elements capable of translocating and/or expressing an engineered muscle-specific targeting moiety polynucleotide to/in a specific cell component or organelle. Such organelles can include, but are not limited to, nucleus, ribosome, endoplasmic reticulum, golgi apparatus, chloroplast, mitochondria, vacuole, lysosome, cytoskeleton, plasma membrane, cell wall, peroxisome, centrioles, etc.

Selectable Markers and Tags

One or more of the engineered muscle-specific targeting moiety polynucleotides can be operably linked, fused to, or otherwise modified to include a polynucleotide that encodes or is a selectable marker or tag, which can be a polynucleotide or polypeptide. In some embodiments, the polynucleotide encoding a polypeptide selectable marker is incorporated in the engineered muscle-specific delivery system polynucleotide such that the selectable marker polynucleotide, when translated, is inserted between two amino acids between the N- and C-terminus of the engineered muscle-specific targeting moiety polypeptide (including but not limited to an engineered AAV capsid polypeptide) or at the N- and/or C-terminus of the engineered muscle-specific targeting moiety polypeptide (including but not limited to an engineered AAV capsid polypeptide). In some embodiments, the selectable marker or tag is a polynucleotide barcode or unique molecular identifier (UMI).

The term "barcode" as used herein refers to a short sequence of nucleotides (for example, DNA or RNA) that is used as an identifier for an associated molecule, such as a target molecule and/or target nucleic acid, or as an identifier of the source of an associated molecule, such as a cell-of-origin. A barcode may also refer to any unique, non-naturally occurring, nucleic acid sequence that may be used to identify the originating source of a nucleic acid fragment. Although it is not necessary to understand the mechanism of an invention, it is believed that the barcode sequence provides a high-quality individual read of a barcode associated with a single cell, a viral vector, labeling ligand (e.g., an aptamer), protein, shRNA, sgRNA or cDNA such that multiple species can be sequenced together.

Barcoding may be performed based on any of the compositions or methods disclosed in patent publication WO 2014047561 A1, compositions and methods for labeling of agents, incorporated herein in its entirety. In certain embodiments barcoding uses an error correcting scheme (T. K. Moon, Error Correction Coding: Mathematical Methods and Algorithms (Wiley, New York, ed. 1, 2005)). Not being bound by a theory, amplified sequences from single cells can be sequenced together and resolved based on the barcode associated with each cell.

In preferred embodiments, sequencing is performed using unique molecular identifiers (UMI). The term "unique molecular identifiers" (UMI) as used herein refers to a sequencing linker or a subtype of nucleic acid barcode used in a method that uses molecular tags to detect and quantify unique amplified products. A UMI is used to distinguish effects through a single clone from multiple clones. The term "clone" as used herein may refer to a single mRNA or target nucleic acid to be sequenced. The UMI may also be used to determine the number of transcripts that gave rise to an amplified product, or in the case of target barcodes as described herein, the number of binding events. In preferred embodiments, the amplification is by PCR or multiple displacement amplification (MDA).

It will be appreciated that the polynucleotide encoding such selectable markers or tags can be incorporated into a polynucleotide encoding one or more components of the engineered muscle-specific delivery system described herein in an appropriate manner to allow expression of the selectable marker or tag. Such techniques and methods are described elsewhere herein and will be instantly appreciated by one of ordinary skill in the art in view of this disclosure. Many such selectable markers and tags are generally known in the art and are intended to be within the scope of this disclosure.

Suitable selectable markers and tags include, but are not limited to, affinity tags, such as chitin binding protein (CBP), maltose binding protein (MBP), glutathione-S-transferase (GST), poly (His) tag; solubilization tags such as thioredoxin (TRX) and poly (NANP), MBP, and GST; chromatography tags such as those consisting of polyanionic amino acids, such as FLAG-tag; epitope tags such as V5-tag, Myc-tag, HA-tag and NE-tag; protein tags that can allow specific enzymatic modification (such as biotinylation by biotin ligase) or chemical modification (such as reaction with FLASH-EDT2 for fluorescence imaging), DNA and/or RNA segments that contain restriction enzyme or other enzyme cleavage sites; DNA segments that encode products that provide resistance against otherwise toxic compounds including antibiotics, such as, spectinomycin, ampicillin, kanamycin, tetracycline, Basta, neomycin phosphotransferase II (NEO), hygromycin phosphotransferase (HPT)) and the like; DNA and/or RNA segments that encode products that are otherwise lacking in the recipient cell (e.g., tRNA genes, auxotrophic markers); DNA and/or RNA segments that encode products which can be readily identified (e.g., phenotypic markers such as β-galactosidase, GUS; fluorescent proteins such as green fluorescent protein (GFP), cyan (CFP), yellow (YFP), red (RFP), luciferase, and cell surface proteins); polynucleotides that can generate one or more new primer sites for PCR (e.g., the juxtaposition of two DNA sequences not previously juxtaposed), DNA sequences not acted upon or acted upon by a restriction endonuclease or other DNA modifying enzyme, chemical, etc.; epitope tags (e.g. GFP, FLAG- and His-tags), and, DNA sequences that make a molecular barcode or unique molecular identifier (UMI), DNA sequences required for a specific modification (e.g., methylation) that allows its identification. Other suitable markers will be appreciated by those of skill in the art.

Selectable markers and tags can be operably linked to one or more components of the engineered AAV capsid system described herein via suitable linker, such as a glycine or glycine serine linkers as short as GS or GG up to $(GGGGG)_3$ (SEQ ID NO: 51) or $(GGGGS)_3$ (SEQ ID NO: 56). Other suitable linkers are described elsewhere herein.

The vector or vector system can include one or more polynucleotides encoding one or more engineered muscle-specific targeting moiety (ies) described elsewhere herein. In some embodiments, the targeting moiety encoding polynucleotides can be included in the vector or vector system, such as a viral vector system, such that they are expressed within and/or on the virus particle(s) produced such that the virus particles can be targeted to specific cells, tissues, organs, etc. In some embodiments, one or more engineered muscle-specific targeting moiety encoding polynucleotides are included in the vector or vector system such that the engineered muscle-specific targeting moiety polynucleotide(s) and/or products expressed therefrom include the targeting moiety and can be targeted to specific cells, tissues, organs, etc., such as muscle cells, muscle tissue, or muscle containing organs (e.g. heart). In some embodiments, such as non-viral carriers, the targeting moiety can be attached to the carrier (e.g. polymer, lipid, inorganic molecule etc.) and can be capable of targeting the carrier and any attached or associated engineered muscle-specific targeting moiety polynucleotide(s) to specific cells, tissues, organs, etc., such as such as muscle cells, muscle tissue, or muscle containing organs (e.g. heart).

Cell-Free Vector and Polynucleotide Expression

In some embodiments, the polynucleotide encoding one or more features of the engineered muscle-specific delivery system containing one or more engineered muscle-specific targeting moieties described herein is expressed from a vector or suitable polynucleotide in a cell-free in vitro system. In other words, the polynucleotide can be transcribed and optionally translated in vitro. In vitro transcription/translation systems and appropriate vectors are generally known in the art and commercially available. Generally, in vitro transcription and in vitro translation systems replicate the processes of RNA and protein synthesis, respectively, outside of the cellular environment. Vectors and suitable polynucleotides for in vitro transcription can include T7, SP6, T3, promoter regulatory sequences that can be recognized and acted upon by an appropriate polymerase to transcribe the polynucleotide or vector.

In vitro translation can be stand-alone (e.g. translation of a purified polyribonucleotide) or linked/coupled to transcription. In some embodiments, the cell-free (or in vitro) translation system can include extracts from rabbit reticulocytes, wheat germ, and/or E. coli. The extracts can include various macromolecular components that are needed for translation of exogenous RNA (e.g. 70S or 80S ribosomes, tRNAs, aminoacyl-tRNA, synthetases, initiation, elongation factors, termination factors, etc.). Other components can be included or added during the translation reaction, including but not limited to, amino acids, energy sources (ATP, GTP), energy regenerating systems (creatine phosphate and creatine phosphokinase (eukaryotic systems)) (phosphoenol pyruvate and pyruvate kinase for bacterial systems), and other co-factors (Mg2+, K+, etc.). As previously mentioned, in vitro translation can be based on RNA or DNA starting material. Some translation systems can utilize an RNA template as starting material (e.g. reticulocyte lysates and wheat germ extracts). Some translation systems can utilize a DNA template as a starting material (e.g. *E coli*-based systems). In these systems, transcription and translation are coupled and DNA is first transcribed into RNA, which is subsequently translated. Suitable standard and coupled cell-free translation systems are generally known in the art and are commercially available.

Codon Optimization of Vector Polynucleotides

As described elsewhere herein, the polynucleotide encoding one or more embodiments of the engineered muscle-specific delivery system described herein is codon optimized. In some embodiments, one or more polynucleotides contained in a vector ("vector polynucleotides") described herein that are in addition to an optionally codon optimized polynucleotide encoding embodiments of the engineered muscle-specific delivery system described herein described herein can be codon optimized. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292(2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. As to codon usage in yeast, reference is made to the online Yeast Genome database available at www.yeastgenome.org/community/codon_usage.shtml, or *Codon selection in yeast*, Bennetzen and Hall, J Biol Chem. 1982 Mar. 25; 257(6): 3026-31. As to codon usage in plants including algae, reference is made to *Codon usage in higher plants, green algae, and cyanobacteria*, Campbell and Gowri, Plant Physiol. 1990 January; 92(1): 1-11.; as well as *Codon usage in plant genes*, Murray et al, Nucleic Acids Res. 1989 Jan. 25; 17(2): 477-98; or *Selection on the codon bias of chloroplast and cyanelle genes in different plant and algal lineages*, Morton B R, J Mol Evol. 1998 April; 46(4): 449-59.

The vector polynucleotide can be codon optimized for expression in a specific cell-type, tissue type, organ type, and/or subject type. In some embodiments, a codon optimized sequence is a sequence optimized for expression in a eukaryote, e.g., humans (i.e. being optimized for expression in a human or human cell), or for another eukaryote, such as another animal (e.g. a mammal or avian) as is described elsewhere herein. Such codon optimized sequences are within the ambit of the ordinary skilled artisan in view of the description herein. In some embodiments, the polynucleotide is codon optimized for a specific cell type. Such cell types can include, but are not limited to, epithelial cells (including skin cells, cells lining the gastrointestinal tract, cells lining other hollow organs), nerve cells (nerves, brain cells, spinal column cells, nerve support cells (e.g. astrocytes, glial cells, Schwann cells etc.), muscle cells (e.g. cardiac muscle, smooth muscle cells, and skeletal muscle cells), connective tissue cells (fat and other soft tissue padding cells, bone cells, tendon cells, cartilage cells), blood cells, stem cells and other progenitor cells, immune system cells, germ cells, and combinations thereof. Such codon optimized sequences are within the ambit of the ordinary skilled artisan in view of the description herein. In some embodiments, the polynucleotide is codon optimized for a specific tissue type. Such tissue types can include, but are not limited to, muscle tissue, connective tissue, connective tissue, nervous tissue, and epithelial tissue. Such codon optimized sequences are within the ambit of the ordinary skilled artisan in view of the description herein. In some embodiments, the polynucleotide is codon optimized for a specific organ. Such organs include, but are not limited to, muscles, skin, intestines, liver, spleen, brain, lungs, stomach, heart, kidneys, gallbladder, pancreas, bladder, thyroid, bone, blood vessels, blood, and combinations thereof. Such codon optimized sequences are within the ambit of the ordinary skilled artisan in view of the description herein.

In some embodiments, a vector polynucleotide is codon optimized for expression in particular cells, such as prokaryotic or eukaryotic cells. he eukaryotic cells may be those of or derived from a particular organism, such as a plant or a mammal, including but not limited to human, or non-human eukaryote or animal or mammal as discussed herein, e.g., mouse, rat, rabbit, dog, livestock, or non-human mammal or primate.

Non-Viral Vectors

In some embodiments, the vector is a non-viral vector or carrier. In some embodiments, non-viral vectors can have the advantage(s) of reduced toxicity and/or immunogenicity and/or increased biosafety as compared to viral vectors. The terms of art "Non-viral vectors and carriers" and as used herein in this context refers to molecules and/or compositions that are not based on one or more component of a virus or virus genome (excluding any nucleotide to be delivered and/or expressed by the non-viral vector) that can be capable of attaching to, incorporating, coupling, and/or otherwise interacting with an engineered muscle-specific targeting moiety polynucleotide of the present invention and can be capable of ferrying the polynucleotide to a cell and/or expressing the polynucleotide. It will be appreciated that this does not exclude the inclusion of a virus-based polynucleotide that is to be delivered. For example, if a gRNA to be delivered is directed against a virus component and it is inserted or otherwise coupled to an otherwise non-viral vector or carrier, this would not make said vector a "viral vector". Non-viral vectors and carriers include naked polynucleotides, chemical-based carriers, polynucleotide (non-viral) based vectors, and particle-based carriers. It will be appreciated that the term "vector" as used in the context of non-viral vectors and carriers refers to polynucleotide vectors and "carriers" used in this context refers to a non-nucleic acid or polynucleotide molecule or composition that be attached to or otherwise interact with a polynucleotide to be delivered, such as an engineered muscle-specific targeting moiety polynucleotide of the present invention.

Naked Polynucleotides

In some embodiments, one or more engineered muscle specific targeting moiety polynucleotides described elsewhere herein can be included in a naked polynucleotide. The term of art "naked polynucleotide" as used herein refers to polynucleotides that are not associated with another molecule (e.g. proteins, lipids, and/or other molecules) that can often help protect it from environmental factors and/or degradation. As used herein, associated with includes, but is not limited to, linked to, adhered to, adsorbed to, enclosed in, enclosed in or within, mixed with, and the like. Naked polynucleotides that include one or more of the engineered muscle specific targeting moiety polynucleotides described herein can be delivered directly to a host cell and optionally expressed therein. The naked polynucleotides can have any suitable two- and three-dimensional configurations. By way of non-limiting examples, naked polynucleotides can be single-stranded molecules, double stranded molecules, circular molecules (e.g. plasmids and artificial chromosomes), molecules that contain portions that are single stranded and portions that are double stranded (e.g. ribozymes), and the like. In some embodiments, the naked polynucleotide contains only the engineered muscle specific targeting moiety polynucleotide(s) of the present invention. In some embodiments, the naked polynucleotide can contain other nucleic acids and/or polynucleotides in addition to the engineered muscle specific targeting moiety polynucleotide(s) of the present invention. The naked polynucleotides can include one or more elements of a transposon system. Transposons and system thereof are described in greater detail elsewhere herein.

Non-Viral Polynucleotide Vectors

In some embodiments, one or more of the engineered muscle specific targeting moiety polynucleotides can be included in a non-viral polynucleotide vector. Suitable non-viral polynucleotide vectors include, but are not limited to, transposon vectors and vector systems, plasmids, bacterial artificial chromosomes, yeast artificial chromosomes, AR (antibiotic resistance)-free plasmids and miniplasmids, circular covalently closed vectors (e.g. minicircles, minivectors, miniknots,), linear covalently closed vectors ("dumbbell shaped"), MIDGE (minimalistic immunologically defined gene expression) vectors, MiLV (micro-linear vector) vectors, Ministrings, mini-intronic plasmids, PSK systems (post-segregationally killing systems), ORT (operator repressor titration) plasmids, and the like. See e.g. Hardee et al. 2017. Genes. 8(2): 65.

In some embodiments, the non-viral polynucleotide vector can have a conditional origin of replication. In some embodiments, the non-viral polynucleotide vector can be an ORT plasmid. In some embodiments, the non-viral polynucleotide vector can have a minimalistic immunologically defined gene expression. In some embodiments, the non-viral polynucleotide vector can have one or more post-segregationally killing system genes. In some embodiments, the non-viral polynucleotide vector is AR-free. In some embodiments, the non-viral polynucleotide vector is a mini-vector. In some embodiments, the non-viral polynucleotide vector includes a nuclear localization signal. In some embodiments, the non-viral polynucleotide vector can include one or more CpG motifs. In some embodiments, the non-viral polynucleotide vectors can include one or more scaffold/matrix attachment regions (S/MARs). See e.g. Mirkovitch et al. 1984. Cell. 39:223-232, Wong et al. 2015. Adv. Genet. 89:113-152, whose techniques and vectors can be adapted for use in the present invention. S/MARs are AT-rich sequences that play a role in the spatial organization of chromosomes through DNA loop base attachment to the nuclear matrix. S/MARs are often found close to regulatory elements such as promoters, enhancers, and origins of DNA replication. Inclusion of one or S/MARs can facilitate a once-per-cell-cycle replication to maintain the non-viral polynucleotide vector as an episome in daughter cells. In embodiments, the S/MAR sequence is located downstream of an actively transcribed polynucleotide (e.g. one or more engineered muscle specific targeting moiety polynucleotides of the present invention) included in the non-viral polynucleotide vector. In some embodiments, the S/MAR can be a S/MAR from the beta-interferon gene cluster. See e.g. Verghese et al. 2014. Nucleic Acid Res. 42: e53; Xu et al. 2016. Sci. China Life Sci. 59:1024-1033; Jin et al. 2016. 8:702-711; Koirala et al. 2014. Adv. Exp. Med. Biol. 801: 703-709; and Nehlsen et al. 2006. Gene Ther. Mol. Biol. 10:233-244, whose techniques and vectors can be adapted for use in the present invention.

In some embodiments, the non-viral vector is a transposon vector or system thereof. As used herein, "transposon" (also referred to as transposable element) refers to a polynucleotide sequence that is capable of moving form location in a genome to another. There are several classes of transposons. Transposons include retrotransposons and DNA transposons. Retrotransposons require the transcription of the polynucleotide that is moved (or transposed) in order to transpose the polynucleotide to a new genome or polynucleotide. DNA transposons are those that do not require reverse transcription of the polynucleotide that is moved (or transposed) in order to transpose the polynucleotide to a new genome or polynucleotide. In some embodiments, the non-viral polynucleotide vector can be a retrotransposon vector. In some embodiments, the retrotransposon vector includes long terminal repeats. In some embodiments, the retrotransposon vector does not include long terminal repeats. In some embodiments, the non-viral polynucleotide vector can be a DNA transposon vector. DNA transposon vectors can include a polynucleotide sequence encoding a transposase. In some embodiments, the transposon vector is configured as a non-autonomous transposon vector, meaning that the transposition does not occur spontaneously on its own. In some of these embodiments, the transposon vector lacks one or more polynucleotide sequences encoding proteins required for transposition. In some embodiments, the non-autonomous transposon vectors lack one or more Ac elements.

In some embodiments, a non-viral polynucleotide transposon vector system can include a first polynucleotide vector that contains the engineered muscle specific targeting moiety polynucleotide(s) of the present invention flanked on the 5' and 3' ends by transposon terminal inverted repeats (TIRs) and a second polynucleotide vector that includes a polynucleotide capable of encoding a transposase coupled to a promoter to drive expression of the transposase. When both are expressed in the same cell the transposase can be expressed from the second vector and can transpose the material between the TIRs on the first vector (e.g. the engineered muscle specific targeting moiety polynucleotide(s) of the present invention) and integrate it into one or more positions in the host cell's genome. In some embodiments, the transposon vector or system thereof can be configured as a gene trap. In some embodiments, the TIRs can be configured to flank a strong splice acceptor site followed by a reporter and/or other gene (e.g. one or more of the engineered muscle specific targeting moiety polynucleotide(s) of the present invention) and a strong poly A tail. When transposition occurs while using this vector or system thereof, the transposon can insert into an intron of a gene and the inserted reporter or other gene can provoke a mis-splicing process and as a result it in activates the trapped gene.

Any suitable transposon system can be used. Suitable transposon and systems thereof can include, Sleeping Beauty transposon system (Tcl/mariner superfamily) (see e.g. Ivics et al. 1997. Cell. 91(4): 501-510), piggyBac (piggyBac superfamily) (see e.g. Li et al. 2013 110(25): E2279-E2287 and Yusa et al. 2011. PNAS. 108(4): 1531-1536), Tol2 (superfamily hAT), Frog Prince (Tcl/mariner superfamily) (see e.g. Miskey et al. 2003 Nucleic Acid Res. 31(23): 6873-6881) and variants thereof.

Viral Vectors

In some embodiments, the vector is a viral vector. The term of art "viral vector" and as used herein in this context refers to polynucleotide based vectors that contain one or more elements from or based upon one or more elements of a virus that can be capable of expressing and packaging a polynucleotide, such as an engineered muscle specific targeting moiety polynucleotide of the present invention, into a virus particle and producing said virus particle when used alone or with one or more other viral vectors (such as in a viral vector system). Viral vectors and systems thereof can be used for producing viral particles for delivery of and/or expression of one or more components of the engineered muscle-specific system described herein. The viral vector can be part of a viral vector system involving multiple vectors. In some embodiments, systems incorporating multiple viral vectors can increase the safety of these systems. Suitable viral vectors can include adenoviral-based vectors, adeno associated vectors, helper-dependent adenoviral (HdAd) vectors, hybrid adenoviral vectors, and the like. Other embodiments of viral vectors and viral particles produce therefrom are described elsewhere herein. In some embodiments, the viral vectors are configured to produce replication incompetent viral particles for improved safety of these systems.

Adenoviral Vectors, Helper-Dependent Adenoviral Vectors, and Hybrid Adenoviral Vectors In some embodiments, the vector can be an adenoviral vector. Accordingly, the present invention is applicable to a virus within the family Adenoviridae, such as Atadenovirus, e.g., Ovine atadenovirus D, Aviadenovirus, e.g., Fowl aviadenovirus A, Ichtadenovirus, e.g., Sturgeon ichtadenovirus A, Mastadenovirus (which includes adenoviruses such as all human adenoviruses), e.g., Human mastadenovirus C, and Siadenovirus, e.g., Frog siadenovirus A. Thus, a virus of within the family Adenoviridae is contemplated as within the invention with discussion herein as to adenovirus applicable to other family members. In some embodiments, the adenoviral vector can include elements such that the virus particle produced using the vector or system thereof can be serotype 2, 5, or 9. In some embodiments, the polynucleotide to be delivered via the adenoviral particle can be up to about 8 kb. Thus, in some embodiments, an adenoviral vector can include a DNA polynucleotide to be delivered that can range in size from about 0.001 kb to about 8 kb. Adenoviral vectors have been used successfully in several contexts (see e.g. Teramato et al. 2000. Lancet. 355:1911-1912; Lai et al. 2002. DNA Cell. Biol. 21:895-913; Flotte et al., 1996. Hum. Gene. Ther. 7:1145-1159; and Kay et al. 2000. Nat. Genet. 24:257-261. The engineered muscle specific targeting moiety (ies) can be included in an adenoviral vector to produce adenoviral particles containing said engineered AAV capsids containing the engineered muscle specific targeting moiety(ies).

In some embodiments, the vector can be a helper-dependent adenoviral vector or system thereof. These are also referred to in the field as "gutless" or "gutted" vectors and are a modified generation of adenoviral vectors (see e.g. Thrasher et al. 2006. Nature. 443: E5-7). In embodiments of the helper-dependent adenoviral vector system, one vector (the helper) can contain all the viral genes required for replication but contains a conditional gene defect in the packaging domain. The second vector of the system can contain only the ends of the viral genome, one or more engineered AAV capsid polynucleotides, and the native packaging recognition signal, which can allow selective packaged release from the cells (see e.g. Cideciyan et al. 2009. N Engl J Med. 361:725-727). Helper-dependent Adenoviral vector systems have been successful for gene delivery in several contexts (see e.g. Simonelli et al. 2010. J Am Soc Gene Ther. 18:643-650; Cideciyan et al. 2009. N Engl J Med. 361:725-727; Crane et al. 2012. Gene Ther. 19(4): 443-452; Alba et al. 2005. Gene Ther. 12:18-S27; Croyle et al. 2005. Gene Ther. 12:579-587; Amalfitano et al. 1998. J. Virol. 72:926-933; and Morral et al. 1999. PNAS. 96:12816-12821). The techniques and vectors described in these publications can be adapted for inclusion of the engineered AAV capsid polynucleotides described herein. In some embodiments, the viral particle containing an engineered muscle specific targeting moiety or encoding polynucleotide is produced from a helper-dependent adenoviral vector or system thereof can be up to about 38 kb. Thus, in some embodiments, an adenoviral vector can range in size from about 0.001 kb to about 37 kb (see e.g. Rosewell et al. 2011. J. Genet. Syndr. Gene Ther. Suppl. 5:001).

In some embodiments, the vector is a hybrid-adenoviral vector or system thereof. Hybrid adenoviral vectors are composed of the high transduction efficiency of a gene-deleted adenoviral vector and the long-term genome-integrating potential of adeno-associated, retroviruses, lentivirus, and transposon based-gene transfer. In some embodiments, such hybrid vector systems can result in stable transduction and limited integration site. See e.g. Balague et al. 2000. Blood. 95:820-828; Morral et al. 1998. Hum. Gene Ther. 9:2709-2716; Kubo and Mitani. 2003. J. Virol. 77(5): 2964-2971; Zhang et al. 2013. PloS One. 8(10) e76771; and Cooney et al. 2015. Mol. Ther. 23(4): 667-674), whose techniques and vectors described therein can be modified and adapted for use in the engineered AAV muscle-specific delivery system of the present invention. In some embodiments, a hybrid-adenoviral vector can include one or more features of a retrovirus and/or an adeno-associated virus. In some embodiments, the hybrid-adenoviral vector can include one or more features of a spuma retrovirus or foamy virus (FV). See e.g. Ehrhardt et al. 2007. Mol. Ther. 15:146-156 and Liu et al. 2007. Mol. Ther. 15:1834-1841, whose techniques and vectors described therein can be modified and adapted for use in the engineered AAV capsid system of the present invention. Advantages of using one or more features from the FVs in the hybrid-adenoviral vector or system thereof can include the ability of the viral particles produced therefrom to infect a broad range of cells, a large packaging capacity as compared to other retroviruses, and the ability to persist in quiescent (non-dividing) cells. See also e.g. Ehrhardt et al. 2007. Mol. Ther. 156:146-156 and Shuji et al. 2011. Mol. Ther. 19:76-82, whose techniques and vectors described therein can be modified and adapted for use in the engineered AAV capsid system of the present invention.

Adeno Associated Vectors

In an embodiment, the engineered vector or system thereof can be an adeno-associated vector (AAV). See, e.g., West et al., Virology 160:38-47(1987); U.S. Pat. No. 4,797, 368; WO 93/24641; Kotin, Human Gene Therapy 5:793-801(1994); and Muzyczka, J. Clin. Invest. 94:1351(1994). Although similar to adenoviral vectors in some of their features, AAVs have some deficiency in their replication and/or pathogenicity and thus can be safer that adenoviral vectors. In some embodiments the AAV can integrate into a specific site on chromosome 19 of a human cell with no observable side effects. In some embodiments, the capacity of the AAV vector, system thereof, and/or AAV particles can be up to about 4.7 kb. The AAV vector or system thereof can include one or more engineered capsid polynucleotides described herein.

The AAV vector or system thereof can include one or more regulatory molecules. In some embodiments the regulatory molecules can be promoters, enhancers, repressors and the like, which are described in greater detail elsewhere herein. In some embodiments, the AAV vector or system thereof can include one or more polynucleotides that can encode one or more regulatory proteins. In some embodiments, the one or more regulatory proteins can be selected from Rep78, Rep68, Rep52, Rep40, variants thereof, and combinations thereof. In some embodiments, the promoter can be a tissue specific promoter as previously discussed. In some embodiments, the tissue specific promoter can drive expression of an engineered capsid AAV capsid polynucleotide described herein. This can be advantageous such as for determining muscle-specific targeting moieties as previously described and as set forth in 62/899,453, 62/916,207, 63/018,454, 63/055,252, and 62/916,221 and International Application No. PCT/US20/50534.

The AAV vector or system thereof can include one or more polynucleotides that can encode one or more capsid proteins, such as the engineered AAV capsid proteins described elsewhere herein. The engineered capsid proteins can be capable of assembling into a protein shell (an engineered capsid) of the AAV virus particle. The engineered capsid can have a cell-, tissue, - and/or organ-specific tropism. In some embodiments, the AAV capsid protein can include one or more engineered muscle-specific targeting moieties described elsewhere herein. In some embodiments, one or more muscle-specific targeting moieties included in the AAV capsid includes an RGD motif as described in greater detail elsewhere herein.

In some embodiments, the AAV vector or system thereof can include one or more adenovirus helper factors or polynucleotides that can encode one or more adenovirus helper factors. Such adenovirus helper factors can include, but are not limited, E1A, E1B, E2A, E4ORF6, and VA RNAs. In some embodiments, a producing host cell line expresses one or more of the adenovirus helper factors.

The AAV vector or system thereof can be configured to produce AAV particles having a specific serotype. In some embodiments, the serotype can be AAV1, AAV2, AAV3, AAV4, AAV5, AAV6, AAV7, AAV8, AAV9, AAV rh.74, AAV rh.10, or any combination thereof. In some embodiments, the AAV can be AAV1, AAV-2, AAV-5, AAV-9 or any combination thereof. One can select the AAV of the AAV with regard to the cells to be targeted; e.g., one can select AAV serotypes 1, 2, 5, 9 or a hybrid capsid AAV-1, AAV-2, AAV-5, AAV-9 or any combination thereof for targeting brain and/or neuronal cells; and one can select AAV-4 for targeting cardiac tissue; and one can select AAV-8 for delivery to the liver. Thus, in some embodiments, an AAV vector or system thereof capable of producing AAV particles capable of targeting the brain and/or neuronal cells can be configured to generate AAV particles having serotypes 1, 2, 5 or a hybrid capsid AAV-1, AAV-2, AAV-5 or any combination thereof. In some embodiments, an AAV vector or system thereof capable of producing AAV particles capable of targeting cardiac tissue can be configured to generate an AAV particle having an AAV-4 serotype. In some embodiments, an AAV vector or system thereof capable of producing AAV particles capable of targeting the liver can be configured to generate an AAV having an AAV-8 serotype. See also Srivastava. 2017. Curr. Opin. Virol. 21:75-80.

It will be appreciated that while the different serotypes can provide some level of cell, tissue, and/or organ specificity, each serotype still is multi-tropic and thus can result in tissue-toxicity if using that serotype to target a tissue that the serotype is less efficient in transducing. Thus, in addition to achieving some tissue targeting capacity via selecting an AAV of a particular serotype, it will be appreciated that the tropism of the AAV serotype can be modified by an engineered AAV capsid described herein. As described elsewhere herein, variants of wild-type AAV of any serotype can be generated via a method described herein and determined to have a particular cell-specific tropism, which can be the same or different as that of the reference wild-type AAV serotype. In some embodiments, the cell, tissue, and/or specificity of the wild-type serotype can be enhanced (e.g. made more selective or specific for a particular cell type that the serotype is already biased towards). For example, wild-type AAV-9 is biased towards muscle and brain in humans (see e.g. Srivastava. 2017. Curr. Opin. Virol. 21:75-80.) By including an engineered AAV capsid and/or capsid protein variant of wild-type AAV-9 as described herein, the bias for e.g. brain can be reduced or eliminated and/or the muscle septicity increased such that the brain specificity appears reduced in comparison, thus enhancing the specificity for the muscle as compared to the wild-type AAV-9. As previously mentioned, inclusion of an engineered capsid and/or capsid protein variant of a wild-type AAV serotype can have a different tropism than the wild-type reference AAV serotype. For example, an engineered AAV capsid and/or capsid protein variant of AAV-9 can have specificity for a tissue other than muscle or brain in humans.

In some embodiments, the AAV vector is a hybrid AAV vector or system thereof. Hybrid AAVs are AAVs that include genomes with elements from one serotype that are packaged into a capsid derived from at least one different serotype. For example, if it is the rAAV2/5 that is to be produced, and if the production method is based on the helper-free, transient transfection method discussed above, the 1st plasmid and the 3rd plasmid (the adeno helper plasmid) will be the same as discussed for rAAV2 production. However, the $2^{nd}$ plasmid, the pRepCap will be different. In this plasmid, called pRep2/Cap5, the Rep gene is still derived from AAV2, while the Cap gene is derived from AAV5. The production scheme is the same as the above-mentioned approach for AAV2 production. The resulting rAAV is called rAAV2/5, in which the genome is based on recombinant AAV2, while the capsid is based on AAV5. It is assumed the cell or tissue-tropism displayed by this AAV2/5 hybrid virus should be the same as that of AAV5. It will be appreciated that wild-type hybrid AAV particles suffer the same specificity issues as with the non-hybrid wild-type serotypes previously discussed.

Advantages achieved by the wild-type based hybrid AAV systems can be combined with the increased and customizable cell-specificity that can be achieved with the engineered AAV capsids can be combined by generating a hybrid AAV that can include an engineered AAV capsid described elsewhere herein. It will be appreciated that hybrid AAVs can contain an engineered AAV capsid containing a genome with elements from a different serotype than the reference wild-type serotype that the engineered AAV capsid is a variant of. For example, a hybrid AAV can be produced that includes an engineered AAV capsid that is a variant of an AAV-9 serotype that is used to package a genome that contains components (e.g. rep elements) from an AAV-2 serotype. As with wild-type based hybrid AAVs previously discussed, the tropism of the resulting AAV particle will be that of the engineered AAV capsid.

A tabulation of certain wild-type AAV serotypes as to these cells can be found in Grimm, D. et al, J. Virol. 82:5887-5911(2008) reproduced below as Table 7. Further tropism details can be found in Srivastava. 2017. Curr. Opin. Virol. 21:75-80 as previously discussed.

TABLE 7

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

In some embodiments, the AAV vector or system thereof is AAV rh.74 or AAV rh.10.

In some embodiments, the AAV vector or system thereof is configured as a "gutless" vector, similar to that described in connection with a retroviral vector. In some embodiments, the "gutless" AAV vector or system thereof can have the cis-acting viral DNA elements involved in genome amplification and packaging in linkage with the heterologous sequences of interest (e.g. the engineered AAV capsid polynucleotide(s)).

Retroviral and Lentiviral Vectors

In some embodiments, the engineered muscle-specific delivery system or component thereof is or is incorporated into a retroviral or lentiviral vector. Retroviral vectors can be composed of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Suitable retroviral vectors for the CRISPR-Cas systems can include those based upon murine leukemia virus (MuLV), gibbon ape leukemia virus (GaLV), Simian immunodeficiency virus (SIV), human immunodeficiency virus (HIV), and combinations thereof (see, e.g., Buchscher et al., J. Virol. 66:2731-2739(1992); Johann et al., J. Virol. 66:1635-1640(1992); Sommnerfelt et al., Virol. 176:58-59(1990); Wilson et al., J. Virol. 63:2374-2378 (1989); Miller et al., J. Virol. 65:2220-2224(1991); PCT/US94/05700). Selection of a retroviral gene transfer system may therefore depend on the target tissue.

The tropism of a retrovirus can be altered by incorporating foreign envelope proteins, expanding the potential target population of target cells. Lentiviral vectors are retroviral vectors that are able to transduce or infect non-dividing cells and are described in greater detail elsewhere herein. A retrovirus can also be engineered to allow for conditional expression of the inserted transgene, such that only certain cell types are infected by the lentivirus. In some embodiments where the end product is a muscle-specific viral particle, the tropism is defined at least in part by the presence of a muscle-specific targeting moiety described herein, such as incorporated within a capsid protein and/or capsid of the retrovirus or lentivirus particles.

Lentiviruses are complex retroviruses that have the ability to infect and express their genes in both mitotic and postmitotic cells. Advantages of using a lentiviral approach can include the ability to transduce or infect non-dividing cells and their ability to typically produce high viral titers, which can increase efficiency or efficacy of production and delivery. Suitable lentiviral vectors include, but are not limited to, human immunodeficiency virus (HIV)-based lentiviral vectors, feline immunodeficiency virus (FIV)-based lentiviral vectors, simian immunodeficiency virus (SIV)-based lentiviral vectors, Moloney Murine Leukaemia Virus (Mo-MLV), Visna-maedi virus (VMV)-based lentiviral vector, caprine arthritis-encephalitis virus (CAEV)-based lentiviral vector, bovine immune deficiency virus (BIV)-based lentiviral vector, and Equine infectious anemia (EIAV)-based lentiviral vector. In some embodiments, an HIV-based lentiviral vector system can be used. In some embodiments, a FIV-based lentiviral vector system can be used.

In some embodiments, the lentiviral vector is an EIAV-based lentiviral vector or vector system. EIAV vectors have been used to mediate expression, packaging, and/or delivery in other contexts, such as for ocular gene therapy (see, e.g., Balagaan, J Gene Med 2006; 8:275-285). In another embodiment, RetinoStat®, (see, e.g., Binley et al., HUMAN GENE THERAPY 23:980-991 (September 2012)), which describes RetinoStat®, an equine infectious anemia virus-based lentiviral gene therapy vector that expresses angiostatic proteins endostatin and angiostatin that is delivered via a subretinal injection for the treatment of the wet form of age-related macular degeneration. Any of these vectors described in these publications can be modified for the elements of the engineered muscle-specific delivery system described herein.

In some embodiments, the lentiviral vector or vector system thereof can be a first-generation lentiviral vector or vector system thereof. First-generation lentiviral vectors can contain a large portion of the lentivirus genome, including the gag and pol genes, other additional viral proteins (e.g. VSV-G) and other accessory genes (e.g. vif, vprm vpu, nef, and combinations thereof), regulatory genes (e.g. tat and/or rev) as well as the gene of interest between the LTRs. First generation lentiviral vectors can result in the production of virus particles that can be capable of replication in vivo, which may not be appropriate for some instances or applications.

In some embodiments, the lentiviral vector or vector system thereof can be a second-generation lentiviral vector or vector system thereof. Second-generation lentiviral vectors do not contain one or more accessory virulence factors and do not contain all components necessary for virus particle production on the same lentiviral vector. This can result in the production of a replication-incompetent virus particle and thus increase the safety of these systems over first-generation lentiviral vectors. In some embodiments, the second-generation vector lacks one or more accessory virulence factors (e.g. vif, vprm, vpu, nef, and combinations thereof). Unlike the first-generation lentiviral vectors, no single second generation lentiviral vector includes all features necessary to express and package a polynucleotide into a virus particle. In some embodiments, the envelope and packaging components are split between two different vectors with the gag, pol, rev, and tat genes being contained on one vector and the envelope protein (e.g. VSV-G) are contained on a second vector. The gene of interest, its promoter, and LTRs can be included on a third vector that can be used in conjunction with the other two vectors (packaging and envelope vectors) to generate a replication-incompetent virus particle.

In some embodiments, the lentiviral vector or vector system thereof can be a third-generation lentiviral vector or vector system thereof. Third-generation lentiviral vectors and vector systems thereof have increased safety over first- and second-generation lentiviral vectors and systems thereof because, for example, the various components of the viral genome are split between two or more different vectors but used together in vitro to make virus particles, they can lack the tat gene (when a constitutively active promoter is included up-stream of the LTRs), and they can include one or more deletions in the 3'LTR to create self-inactivating (SIN) vectors having disrupted promoter/enhancer activity of the LTR. In some embodiments, a third-generation lentiviral vector system can include (i) a vector plasmid that contains the polynucleotide of interest and upstream promoter that are flanked by the 5' and 3' LTRs, which can optionally include one or more deletions present in one or both of the LTRs to render the vector self-inactivating; (ii) a "packaging vector(s)" that can contain one or more genes involved in packaging a polynucleotide into a virus particle that is produced by the system (e.g. gag, pol, and rev) and upstream regulatory sequences (e.g. promoter(s)) to drive expression of the features present on the packaging vector, and (iii) an "envelope vector" that contains one or more envelope protein genes and upstream promoters. In certain embodiments, the third-generation lentiviral vector system can include at least two packaging vectors, with the gag-pol being present on a different vector than the rev gene.

In some embodiments, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2: 36ra43) can be used/and or adapted to the CRISPR-Cas system of the present invention.

In some embodiments, the pseudotype and infectivity or tropism of a lentivirus particle can be tuned by altering the type of envelope protein(s) included in the lentiviral vector or system thereof. As used herein, an "envelope protein" or "outer protein" means a protein exposed at the surface of a viral particle that is not a capsid protein. For example, envelope or outer proteins typically comprise proteins embedded in the envelope of the virus. In some embodiments, a lentiviral vector or vector system thereof can include a VSV-G envelope protein. VSV-G mediates viral attachment to an LDL receptor (LDLR) or an LDLR family member present on a host cell, which triggers endocytosis of the viral particle by the host cell. Because LDLR is expressed by a wide variety of cells, viral particles expressing the VSV-G envelope protein can infect or transduce a wide variety of cell types. Other suitable envelope proteins can be incorporated based on the host cell that a user desires to be infected by a virus particle produced from a lentiviral vector or system thereof described herein and can include, but are not limited to, feline endogenous virus envelope protein (RD114) (see e.g. Hanawa et al. Molec. Ther. 2002 5(3) 242-251), modified Sindbis virus envelope proteins (see e.g. Morizono et al. 2010. J. Virol. 84(14) 6923-6934; Morizono et al. 2001. J. Virol. 75:8016-8020; Morizono et al. 2009. J. Gene Med. 11:549-558; Morizono et al. 2006 Virology 355:71-81; Morizono et al J. Gene Med. 11:655-663, Morizono et al. 2005 Nat. Med. 11:346-352), baboon retroviral envelope protein (see e.g. Girard-Gagnepain et al. 2014. Blood. 124:1221-1231); Tupaia paramyxovirus glycoproteins (see e.g. Enkirch T. et al., 2013. Gene Ther. 20:16-23); measles virus glycoproteins (see e.g. Funke et al. 2008. Molec. Ther. 16(8): 1427-1436), rabies virus envelope proteins, MLV envelope proteins, Ebola envelope proteins, baculovirus envelope proteins, filovirus envelope proteins, hepatitis E1 and E2 envelope proteins, gp41 and gp120 of HIV, hemagglutinin, neuraminidase, M2 proteins of influenza virus, and combinations thereof.

In some embodiments, the tropism of the resulting lentiviral particle can be tuned by incorporating cell targeting peptides into a lentiviral vector such that the cell targeting peptides are expressed on the surface of the resulting lentiviral particle. In some embodiments, a lentiviral vector can contain an envelope protein that is fused to a cell targeting protein (see e.g. Buchholz et al. 2015. Trends Biotechnol. 33:777-790; Bender et al. 2016. PLOS Pathog. 12(e1005461); and Friedrich et al. 2013. Mol. Ther. 2013. 21:849-859.

In some embodiments, a split-intein-mediated approach to target lentiviral particles to a specific cell type can be used (see e.g. Chamoun-Emaneulli et al. 2015. Biotechnol. Bioeng. 112:2611-2617, Ramirez et al. 2013. Protein. Eng. Des. Sel. 26:215-233. In these embodiments, a lentiviral vector can contain one half of a splicing-deficient variant of the naturally split intein from *Nostoc punctiforme* fused to a cell targeting peptide and the same or different lentiviral vector can contain the other half of the split intein fused to an envelope protein, such as a binding-deficient, fusion-competent virus envelope protein. This can result in production of a virus particle from the lentiviral vector or vector system that includes a split intein that can function as a molecular Velcro linker to link the cell-binding protein to the pseudotyped lentivirus particle. This approach can be advantageous for use where surface-incompatibilities can restrict the use of, e.g., cell targeting peptides.

In some embodiments, a covalent-bond-forming protein-peptide pair can be incorporated into one or more of the lentiviral vectors described herein to conjugate a cell targeting peptide to the virus particle (see e.g. Kasaraneni et al. 2018. Sci. Reports (8) No. 10990). In some embodiments, a lentiviral vector can include an N-terminal PDZ domain of InaD protein (PDZ1) and its pentapeptide ligand (TEFCA) from NorpA, which can conjugate the cell targeting peptide to the virus particle via a covalent bond (e.g. a disulfide bond). In some embodiments, the PDZ1 protein can be fused to an envelope protein, which can optionally be binding deficient and/or fusion competent virus envelope protein and included in a lentiviral vector. In some embodiments, the TEFCA can be fused to a cell targeting peptide and the TEFCA-CPT fusion construct can be incorporated into the same or a different lentiviral vector as the PDZ1-envelope protein construct. During virus production, specific interaction between the PDZ1 and TEFCA facilitates producing virus particles covalently functionalized with the cell targeting peptide and thus capable of targeting a specific cell-type based upon a specific interaction between the cell targeting peptide and cells expressing its binding partner. This approach can be advantageous for use where surface-incompatibilities can restrict the use of, e.g., cell targeting peptides.

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259, 015. Any of these systems or a variant thereof can be used to deliver an engineered muscle-specific polynucleotide to a cell and/or incorporate a muscle-specific targeting moiety described herein for muscle-specific delivery to a cell.

In some embodiments, a lentiviral vector system can include one or more transfer plasmids. Transfer plasmids can be generated from various other vector backbones and can include one or more features that can work with other retroviral and/or lentiviral vectors in the system that can, for example, improve safety of the vector and/or vector system, increase virial titers, and/or increase or otherwise enhance expression of the desired insert to be expressed and/or packaged into the viral particle. Suitable features that can be included in a transfer plasmid can include, but are not limited to, 5'LTR, 3'LTR, SIN/LTR, origin of replication (Ori), selectable marker genes (e.g. antibiotic resistance genes), Psi (4), RRE (rev response element), cPPT (central polypurine tract), promoters, WPRE (woodchuck hepatitis post-transcriptional regulatory element), SV40 polyadenylation signal, pUC origin, SV40 origin, F1 origin, and combinations thereof.

In another embodiment, Cocal vesiculovirus envelope pseudotyped retroviral or lentiviral vector particles are contemplated (see, e.g., US Patent Publication No. 20120164118 assigned to the Fred Hutchinson Cancer Research Center). Cocal virus is in the Vesiculovirus genus and is a causative agent of vesicular stomatitis in mammals. Cocal virus was originally isolated from mites in Trinidad (Jonkers et al., Am. J. Vet. Res. 25:236-242(1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242(1964) and Travassos da Rosa et al., Am. J. Tropical Med. & Hygiene 33:999-1006(1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. In certain embodiments of these embodiments, the Gag, Pol, and accessory proteins are lentiviral and/or gammaretroviral. In some embodiments, a retroviral vector can contain encoding polypeptides for one or more Cocal vesiculovirus envelope proteins such that the resulting viral or pseudoviral particles are Cocal vesiculovirus envelope pseudotyped.

Herpes Simplex Viral Vectors

In some embodiments, the vector can be a Herpes Simplex Viral (HSV)-based vector or system thereof. HSV systems can include the disabled infections single copy (DISC) viruses, which are composed of a glycoprotein H defective mutant HSV genome. When the defective HSV is propagated in complementing cells, virus particles can be generated that are capable of infecting subsequent cells permanently replicating their own genome but are not capable of producing more infectious particles. See e.g. 2009. Trobridge. Exp. Opin. Biol. Ther. 9:1427-1436, whose techniques and vectors described therein can be modified and adapted for use in the CRISPR-Cas system of the present invention. In some embodiments where an HSV vector or system thereof is utilized, the host cell can be a complementing cell. In some embodiments, HSV vector or system thereof can be capable of producing virus particles capable of delivering a polynucleotide cargo of up to 150 kb. Thus, in some embodiment the engineered muscle-specific targeting moiety polynucleotide(s) included in the HSV-based viral vector or system thereof can sum from about 0.001 to about 150 kb. HSV-based vectors and systems thereof have been successfully used in several contexts including various models of neurologic disorders. See e.g. Cockrell et al. 2007. Mol. Biotechnol. 36:184-204; Kafri T. 2004. Mol. Biol. 246:367-390; Balaggan and Ali. 2012. Gene Ther. 19:145-153; Wong et al. 2006. Hum. Gen. Ther. 2002. 17:1-9; Azzouz et al. J. Neurosci. 22L10302-10312; and Betchen and Kaplitt. 2003. Curr. Opin. Neurol. 16:487-493. Any of these systems or a variant thereof can be used to deliver an engineered muscle-specific polynucleotide to a cell and/or incorporate a muscle-specific targeting moiety described herein for muscle-specific delivery to a cell.

Poxvirus Vectors

In some embodiments, the vector can be a poxvirus vector or system thereof. In some embodiments, the poxvirus vector can result in cytoplasmic expression of one or more cargos that can be packaged by such virus of the present invention. In some embodiments, the capacity of a poxvirus vector or system thereof can be about 25 kb or more. In some embodiments, a poxvirus vector or system thereof can include one or more engineered muscle-specific targeting moiety polynucleotides and/or muscle-specific targeting moieties, engineered capsid proteins, and/or capsids described herein.

Viral Vectors for Delivery to Plants

The systems and compositions may be delivered to plant cells using viral vehicles. Plant cells can be engineered to express compositions (such as proteins) that can contain muscle-specific targeting moiety (ies) that can be subsequently harvested and used as appropriate, such as a therapy for humans or non-human animals. In particular embodiments, the compositions and systems may be introduced in the plant cells using a plant viral vector (e.g., as described in Scholthof et al. 1996, Annu Rev Phytopathol. 1996; 34:299-323). Such viral vector may be a vector from a DNA virus, e.g., geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., Faba bean necrotic yellow virus). The viral vector may be a vector from an RNA virus, e.g., tobravirus (e.g., tobacco rattle virus, tobacco mosaic virus), potexvirus (e.g., potato virus X), or hordeivirus (e.g., barley stripe mosaic virus). The replicating genomes of plant viruses may be non-integrative vectors.

Vector Construction

The vectors described herein can be constructed using any suitable process or technique. In some embodiments, one or more suitable recombination and/or cloning methods or techniques can be used to the vector(s) described herein. Suitable recombination and/or cloning techniques and/or methods can include, but not limited to, those described in U.S. Application publication No. US 2004-0171156 A1. Other suitable methods and techniques are described elsewhere herein.

Construction of recombinant AAV vectors are described in a number of publications, including U.S. Pat. No. 5,173, 414; Tratschin et al., Mol. Cell. Biol. 5:3251-3260 (1985); Tratschin, et al., Mol. Cell. Biol. 4:2072-2081(1984); Hermonat & Muzyczka, PNAS 81:6466-6470(1984); and Samulski et al., J. Virol. 63:03822-3828(1989). Any of the techniques and/or methods can be used and/or adapted for constructing an AAV or other vector described herein. AAV vectors are discussed elsewhere herein.

In some embodiments, the vector can have one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors.

Delivery vehicles, vectors, particles, nanoparticles, formulations and components thereof for expression of one or more elements of an engineered AAV capsid system described herein are as used in the foregoing documents, such as WO 2014/093622 (PCT/US2013/074667) and are discussed in greater detail herein.

Virus Particle Production from Viral Vectors

AAV Particle Production

There are two main strategies for producing AAV particles from AAV vectors and systems thereof, such as those described herein, which depend on how the adenovirus helper factors are provided (helper v. helper free). In some embodiments, a method of producing AAV particles from AAV vectors and systems thereof can include adenovirus infection into cell lines that stably harbor AAV replication and capsid encoding polynucleotides along with AAV vector containing the polynucleotide to be packaged and delivered by the resulting AAV particle (e.g. the engineered AAV capsid polynucleotide(s)). In some embodiments, a method of producing AAV particles from AAV vectors and systems thereof can be a "helper free" method, which includes co-transfection of an appropriate producing cell line with three vectors (e.g. plasmid vectors): (1) an AAV vector that contains a polynucleotide of interest (e.g. the engineered AAV capsid polynucleotide(s)) between 2 ITRs; (2) a vector that carries the AAV Rep-Cap encoding polynucleotides; and (helper polynucleotides. One of skill in the art will appreciate various methods and variations thereof that are both helper and -helper free and as well as the different advantages of each system.

The engineered AAV vectors and systems thereof described herein can be produced by any of these methods.

Retroviral Production

In some embodiments, one or more viral vectors and/or system thereof can be delivered to a suitable cell line for production of virus particles containing the polynucleotide or other payload to be delivered to a host cell. Suitable host cells for virus production from viral vectors and systems thereof described herein are known in the art and are commercially available. For example, suitable host cells include HEK 293 cells and its variants (HEK 293T and HEK 293TN cells). In some embodiments, the suitable host cell for virus production from viral vectors and systems thereof described herein can stably express one or more genes involved in packaging (e.g. pol, gag, and/or VSV-G) and/or other supporting genes.

In some embodiments, after delivery of one or more viral vectors to the suitable host cells for or virus production from viral vectors and systems thereof, the cells are incubated for an appropriate length of time to allow for viral gene expression from the vectors, packaging of the polynucleotide or other cargo to be delivered (e.g. an CRISPR-Cas system polynucleotide), and virus particle assembly, and secretion of mature virus particles into the culture media. Various other methods and techniques are generally known to those of ordinary skill in the art.

Mature virus particles can be collected from the culture media by a suitable method. In some embodiments, this can involve centrifugation to concentrate the virus. The titer of the composition containing the collected virus particles can be obtained using a suitable method. Such methods can include transducing a suitable cell line (e.g. NIH 3T3 cells) and determining transduction efficiency, infectivity in that cell line by a suitable method. Suitable methods include PCR-based methods, flow cytometry, and antibiotic selection-based methods. Various other methods and techniques are generally known to those of ordinary skill in the art. The concentration of virus particle can be adjusted as needed. In some embodiments, the resulting composition containing virus particles can contain $1\times10^1$-$1\times10^{20}$ particles/mL.

Lentiviruses may be prepared from any lentiviral vector or vector system described herein. In one example embodiment, after cloning pCasES10 (which contains a lentiviral transfer plasmid backbone), HEK293FT at low passage (p=5) can be seeded in a T-75 flask to 50% confluence the day before transfection in DMEM with 10% fetal bovine serum and without antibiotics. After 20 hours, the media can be changed to OptiMEM (serum-free) media and transfection of the lentiviral vectors can done 4 hours later. Cells can be transfected with 10 μg of lentiviral transfer plasmid (pCasES10) and the appropriate packaging plasmids (e.g., 5 μg of pMD2.G (VSV-g pseudotype), and 7.5 μg of psPAX2 (gag/pol/rev/tat)). Transfection can be carried out in 4 mL OptiMEM with a cationic lipid delivery agent (50 uL Lipofectamine 2000 and 100 ul Plus reagent). After 6 hours, the media can be changed to antibiotic-free DMEM with 10% fetal bovine serum. These methods can use serum during cell culture, but serum-free methods are preferred.

Following transfection and allowing the producing cells (also referred to as packaging cells) to package and produce virus particles with packaged cargo, the lentiviral particles can be purified. In an exemplary embodiment, virus-containing supernatants can be harvested after 48 hours. Collected virus-containing supernatants can first be cleared of debris and filtered through a 0.45 um low protein binding (PVDF) filter. They can then be spun in an ultracentrifuge for 2 hours at 24,000 rpm. The resulting virus-containing pellets can be resuspended in 50 ul of DMEM overnight at 4 degrees C. They can be then aliquoted and used immediately or immediately frozen at −80 degrees C. for storage.

Vector and Virus Particle Delivery

A vector (including non-viral carriers) described herein can be introduced into host cells to thereby produce transcripts, proteins, or peptides, including fusion proteins or peptides encoded by nucleic acids as described herein (e.g., engineered AAV capsid system transcripts, proteins, enzymes, mutant forms thereof, fusion proteins thereof, etc.), and virus particles (such as from viral vectors and systems thereof).

One or more engineered AAV capsid polynucleotides can be delivered using adeno associated virus (AAV), adenovirus or other plasmid or viral vector types as previously described, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus.

For plasmid delivery, the route of administration, formulation and dose can be as in U.S. Pat. No. 5,846,946 and as in clinical studies involving plasmids. In some embodiments, doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into or otherwise delivered to the tissue or cell of interest.

In terms of in vivo delivery, AAV is advantageous over other viral vectors for a couple of reasons such as low toxicity (this may be due to the purification method not requiring ultra-centrifugation of cell particles that can activate the immune response) and a low probability of causing insertional mutagenesis because it doesn't integrate into the host genome.

The vector(s) and virus particles described herein can be delivered in to a host cell in vitro, in vivo, and/or ex vivo. Delivery can occur by any suitable method including, but not limited to, physical methods, chemical methods, and biological methods. Physical delivery methods are those methods that employ physical force to counteract the membrane barrier of the cells to facilitate intracellular delivery of the vector. Suitable physical methods include, but are not limited to, needles (e.g. injections), ballistic polynucleotides (e.g. particle bombardment, micro projectile gene transfer, and gene gun), electroporation, sonoporation, photoporation, magnetofection, hydroporation, and mechanical massage. Chemical methods are those methods that employ a chemical to elicit a change in the cells membrane permeability or other characteristic(s) to facilitate entry of the vector into the cell. For example, the environmental pH can be altered which can elicit a change in the permeability of the cell membrane. Biological methods are those that rely and capitalize on the host cell's biological processes or biological characteristics to facilitate transport of the vector (with or without a carrier) into a cell. For example, the vector and/or its carrier can stimulate an endocytosis or similar process in the cell to facilitate uptake of the vector into the cell.

Delivery of engineered AAV capsid system components (e.g. polynucleotides encoding engineered AAV capsid and/or capsid proteins) to cells via particles. The term "particle" as used herein, refers to any suitable sized particles for delivery of the engineered AAV capsid system components described herein. Suitable sizes include macro-, micro-, and nano-sized particles. In some embodiments, any of the engineered AAV capsid system components (e.g. polypeptides, polynucleotides, vectors and combinations thereof described herein) can be attached to, coupled to, integrated with, otherwise associated with one or more particles or component thereof as described herein. The particles described herein can then be administered to a cell or organism by an appropriate route and/or technique. In some embodiments, particle delivery can be selected and be advantageous for delivery of the polynucleotide or vector components. It will be appreciated that in embodiments, particle delivery can also be advantageous for other engineered capsid system molecules and formulations described elsewhere herein.

Engineered Virus Particles

Also described herein are engineered virus particles (also referred to herein as "engineered viral particles") that can contain an engineered muscle-specific capsid (e.g. a capsid containing one or more engineered capsid polypeptides having one or more engineered muscle-specific targeting moieties as described in detail elsewhere herein). Also described herein are virus particles containing, as cargo, one or more engineered muscle-specific targeting moiety polynucleotides described elsewhere herein.

It will be appreciated that the engineered viral particles can be lentiviral-based, retroviral-based, poxvirus-based, herpesvirus-based, adenovirus-based particles, helper adenovirus-based particles, AAV-based particles, or hybrid adenovirus-based particles that contain at least one engineered capsid protein as previously described. An engineered viral capsid is one that contains one or more engineered capsid proteins that contain one or more muscle-specific targeting moieties as are described elsewhere herein. In some embodiments, the engineered viral capsid is an engineered AAV capsids.

In some embodiments, the engineered AAV particles can include 1-60 engineered AAV capsid proteins described herein. In some embodiments, the engineered AAV particles can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 engineered capsid proteins. In some embodiments, the engineered AAV particles can contain 0-59 wild-type AAV capsid proteins. In some embodiments, the engineered AAV particles can contain 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, or 59 wild-type AAV capsid proteins. The engineered AAV particles can thus include one or more n-mer motifs as is previously described. In some embodiments, the n-mer is an RGD motif.

The engineered virus particles can each include one or more cargo polynucleotides. Cargo polynucleotides are discussed in greater detail elsewhere herein. Methods of making the engineered AAV particles from viral and non-viral vectors are described elsewhere herein. Formulations containing the engineered virus particles are described elsewhere herein.

Engineered Non-Vector Delivery Vehicles

In some embodiments, the muscle-specific targeting moiety is incorporated in a non-vector delivery vehicle. In some embodiments, the muscle specific targeting moiety is operably coupled or otherwise attached to the non-vector delivery vehicle. As used herein, "attached" can refer to covalent or non-covalent interaction between two or more molecules. Non-covalent interactions can include ionic bonds, electrostatic interactions, van der Walls forces, dipole-dipole interactions, dipole-induced-dipole interactions, London dispersion forces, hydrogen bonding, halogen bonding, electromagnetic interactions, x-x interactions, cation-x interactions, anion-x interactions, polar x-interactions, and hydrophobic effects. In some embodiments, the muscle-specific targeting moiety is incorporated into a composition (such as a protein or polynucleotide) that is operably coupled to or is otherwise attached to the non-vector delivery vehicle. In some embodiments, the engineered muscle-specific targeting moiety is operatively coupled or otherwise attached such that the muscle specific targeting moiety is on a surface of the non-vector delivery vehicle. The delivery vehicles may comprise non-viral vehicles. In general, methods and vehicles capable of delivering nucleic acids and/or proteins may be used for delivering the systems compositions herein. Examples of non-viral vehicles include lipid nanoparticles, cell-penetrating peptides (CPPs), DNA nanoclews, metal nanoparticles, streptolysin O, multifunctional envelope-type nanodevices (MENDs), lipid-coated mesoporous silica particles, and other inorganic nanoparticles.

Lipid Particles

The delivery vehicles may comprise lipid particles, e.g., lipid nanoparticles (LNPs) and liposomes. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, International Patent Publication Nos. WO 91/17424 and WO 91/16024. The preparation of lipid: nucleic acid complexes, including targeted liposomes such as immunolipid complexes, is well known to one of skill in the art (see, e.g., Crystal, Science 270:404-410(1995); Blaese et al., Cancer Gene Ther. 2:291-297 (1995); Behr et al., Bioconjugate Chem. 5:382-389(1994); Remy et al., Bioconjugate Chem. 5:647-654(1994); Gao et al., Gene Therapy 2:710-722 (1995); Ahmad et al., Cancer Res. 52:4817-4820(1992); U.S. Pat. Nos. 4,186,183, 4,217,344, 4,235,871, 4,261,975, 4,485,054, 4,501,728, 4,774,085, 4,837,028, and 4,946, 787).

Lipid Nanoparticles (LNPs)

LNPs may encapsulate nucleic acids within cationic lipid particles (e.g., liposomes) and may be delivered to cells with relative ease. In some examples, lipid nanoparticles do not contain any viral components, which helps minimize safety and immunogenicity concerns. Lipid particles may be used for in vitro, ex vivo, and in vivo deliveries. Lipid particles may be used for various scales of cell populations.

In some embodiments, LNPs may be used for delivering DNA molecules (e.g., those comprising coding sequences of Cas and/or gRNA) and/or RNA molecules (e.g., mRNA of Cas, gRNAs). In certain cases, LNPs may be use for delivering RNP complexes of Cas/gRNA.

Components in LNPs may comprise cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), R-3-[(ro-methoxy-poly (ethylene glycol) 2000) carbamoyl]-1,2-dimyristyloxlpropyl-3-amine (PEG-C-DOMG, and any combination thereof. Preparation of LNPs and encapsulation may be adapted from Rosin et al, Molecular Therapy, vol. 19, no. 12, pages 1286-2220, December 2011).

In some embodiments, an LNP delivery vehicle can be used to deliver a virus particle containing a CRISPR-Cas system and/or component(s) thereof. In some embodiments, the virus particle(s) can be adsorbed to the lipid particle, such as through electrostatic interactions, and/or can be attached to the liposomes via a linker.

In some embodiments, the LNP contains a nucleic acid, wherein the charge ratio of nucleic acid backbone phosphates to cationic lipid nitrogen atoms is about 1:1.5-7 or about 1:4.

In some embodiments, the LNP also includes a shielding compound, which is removable from the lipid composition under in vivo conditions. In some embodiments, the shielding compound is a biologically inert compound. In some embodiments, the shielding compound does not carry any charge on its surface or on the molecule as such. In some embodiments, the shielding compounds are polyethylene glycols (PEGs), hydroxyethylglucose (HEG) based polymers, polyhydroxyethyl starch (polyHES) and polypropylene. In some embodiments, the PEG, HEG, polyHES, and a polypropylene weight between about 500 to 10,000 Da or between about 2000 to 5000 Da. In some embodiments, the shielding compound is PEG2000 or PEG5000.

In some embodiments, the LNP can include one or more helper lipids. In some embodiments, the helper lipid can be a phosphor lipid or a steroid. In some embodiments, the helper lipid is between about 20 mol % to 80 mol % of the total lipid content of the composition. In some embodiments, the helper lipid component is between about 35 mol % to 65 mol % of the total lipid content of the LNP. In some embodiments, the LNP includes lipids at 50 mol % and the helper lipid at 50 mol % of the total lipid content of the LNP.

Other non-limiting, exemplary LNP delivery vehicles are described in U.S. Patent Publication Nos. US20160174546, US 20140301951, US 20150105538, US 20150250725, Wang et al., J. Control Release, 2017 Jan. 31. pii: S0168-3659(17) 30038-X. doi: 10.1016/j.jconrel.2017.01.037. [Epub ahead of print]; Altinoğlu et al., Biomater Sci., 4(12):

1773-80, Nov. 15, 2016; Wang et al., PNAS, 113(11): 2868-73 Mar. 15, 2016; Wang et al., PloS One, 10(11): e0141860. doi: 10.1371/journal.pone.0141860. eCollection 2015, Nov. 3, 2015; Takeda et al., Neural Regen Res. 10(5): 689-90, May 2015; Wang et al., Adv. Healthc Mater., 3(9): 1398-403, September 2014; and Wang et al., Agnew Chem Int Ed Engl., 53(11): 2893-8, Mar. 10, 2014; James E. Dahlman and Carmen Barnes et al. Nature Nanotechnology (2014) published online 11 May 2014, doi: 10.1038/nnano.2014.84; Coelho et al., N Engl J Med 2013; 369:819-29; Aleku et al., Cancer Res., 68(23): 9788-98 (Dec. 1, 2008), Strumberg et al., Int. J. Clin. Pharmacol. Ther., 50(1): 76-8 (January 2012), Schultheis et al., *J. Clin. Oncol.*, 32(36): 4141-48 (Dec. 20, 2014), and Fehring et al., Mol. Ther., 22(4): 811-20 (Apr. 22, 2014); Novobrantseva, Molecular Therapy-Nucleic Acids (2012) 1, e4; doi: 10.1038/mtna.2011.3; WO2012135025; US20140348900; US20140328759; US 20140308304; WO 2005/105152; WO 2006/069782; WO 2007/121947; US 2015/082080; US 20120251618; U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316.

Liposomes

In some embodiments, a lipid particle may be liposome. Liposomes are spherical vesicle structures composed of a uni- or multilamellar lipid bilayer surrounding internal aqueous compartments and a relatively impermeable outer lipophilic phospholipid bilayer. In some embodiments, liposomes are biocompatible, nontoxic, can deliver both hydrophilic and lipophilic drug molecules, protect their cargo from degradation by plasma enzymes, and transport their load across biological membranes and the blood brain barrier (BBB).

Liposomes can be made from several different types of lipids, e.g., phospholipids. A liposome may comprise natural phospholipids and lipids such as 1,2-distearoyl-sn-glycero-3-phosphatidyl choline (DSPC), sphingomyelin, egg phosphatidylcholines, monosialoganglioside, or any combination thereof.

Several other additives may be added to liposomes in order to modify their structure and properties. For instance, liposomes may further comprise cholesterol, sphingomyelin, and/or 1,2-dioleoyl-sn-glycero-3-phosphoethanolamine (DOPE), e.g., to increase stability and/or to prevent the leakage of the liposomal inner cargo.

In some embodiments, a liposome delivery vehicle can be used to deliver a virus particle containing a CRISPR-Cas system and/or component(s) thereof. In some embodiments, the virus particle(s) can be adsorbed to the liposome, such as through electrostatic interactions, and/or can be attached to the liposomes via a linker.

In some embodiments, the liposome can be a Trojan Horse liposome (also known in the art as Molecular Trojan Horses), see e.g. cshprotocols.cshlp.org/content/2010/4/pdb.prot5407.long, the teachings of which can be applied and/or adapted to generated and/or deliver the CRISPR-Cas systems described herein.

Other non-limiting, exemplary liposomes can be those as set forth in Wang et al., ACS Synthetic Biology, 1, 403-07 (2012); Wang et al., PNAS, 113(11) 2868-2873(2016); Spuch and Navarro, Journal of Drug Delivery, vol. 2011, Article ID 469679, 12 pages, 2011. doi: 10.1155/2011/469679; WO 2008/042973; U.S. Pat. No. 8,071,082; WO 2014/186366; 20160257951; US20160129120; US20160244761; 20120251618; WO2013/093648; Lipofectin (a combination of DOTMA and DOPE), Lipofectase, LIPOFECTAMINE® (e.g., LIPOFECTAMINE® 2000, LIPOFECTAMINE® 3000, LIPOFECTAMINE® RNAiMAX, LIPOFECTAMINE® LTX), SAINT-RED (Synvolux Therapeutics, Groningen Netherlands), DOPE, Cytofectin (Gilead Sciences, Foster City, Calif.), and Eufectins (JBL, San Luis Obispo, Calif.).

Stable Nucleic-Acid-Lipid Particles (SNALPs)

In some embodiments, the lipid particles may be stable nucleic acid lipid particles (SNALPs). SNALPs may comprise an ionizable lipid (DLinDMA) (e.g., cationic at low pH), a neutral helper lipid, cholesterol, a diffusible polyethylene glycol (PEG)-lipid, or any combination thereof. In some examples, SNALPs may comprise synthetic cholesterol, dipalmitoylphosphatidylcholine, 3-N-[(w-methoxy polyethylene glycol) 2000) carbamoyl]-1,2-dimyristoyloxy-propylamine, and cationic 1,2-dilinoleyloxy-3-N,Ndimethylaminopropane. In some examples, SNALPs may comprise synthetic cholesterol, 1,2-distearoyl-sn-glycero-3-phosphocholine, PEG-CDMA, and 1,2-dilinoleyloxy-3-(N;N-dimethyl)aminopropane (DLinDMAo).

Other non-limiting, exemplary SNALPs that can be used to deliver the CRISPR-Cas systems described herein can be any such SNALPs as described in Morrissey et al., Nature Biotechnology, Vol. 23, No. 8, August 2005, Zimmerman et al., Nature Letters, Vol. 441, 4 May 2006; Geisbert et al., Lancet 2010; 375:1896-905; Judge, J. Clin. Invest. 119:661-673 (2009); and Semple et al., Nature Biotechnology, Volume 28 Number 2 February 2010, pp. 172-177.

Other Lipids

The lipid particles may also comprise one or more other types of lipids, e.g., cationic lipids, such as amino lipid 2,2-dilinoleyl-4-dimethylaminoethyl-[1,3]-dioxolane (DLin-KC2-DMA), DLin-KC2-DMA4, C12-200 and colipids distearoylphosphatidyl choline, cholesterol, and PEG-DMG.

In some embodiments, the delivery vehicle can be or include a lipidoid, such as any of those set forth in, for example, US 20110293703.

In some embodiments, the delivery vehicle can be or include an amino lipid, such as any of those set forth in, for example, Jayaraman, Angew. Chem. Int. Ed. 2012, 51, 8529-8533.

In some embodiments, the delivery vehicle can be or include a lipid envelope, such as any of those set forth in, for example, Korman et al., 2011. Nat. Biotech. 29:154-157.

Lipoplexes/Polyplexes

In some embodiments, the delivery vehicles comprise lipoplexes and/or polyplexes. Lipoplexes may bind to negatively charged cell membrane and induce endocytosis into the cells. Examples of lipoplexes may be complexes comprising lipid(s) and non-lipid components. Examples of lipoplexes and polyplexes include FuGENE-6 reagent, a non-liposomal solution containing lipids and other components, zwitterionic amino lipids (ZALs), Ca2p (e.g., forming DNA/Ca2+ microcomplexes), polyethenimine (PEI) (e.g., branched PEI), and poly (L-lysine) (PLL).

Sugar-Based Particles

In some embodiments, the delivery vehicle can be a sugar-based particle. In some embodiments, the sugar-based particles can be or include GalNAc, such as any of those described in WO2014118272; US20020150626; Nair, J K et al., 2014, Journal of the American Chemical Society 136 (49), 16958-16961; Østergaard et al., Bioconjugate Chem., 2015, 26(8), pp 1451-1455.

Cell Penetrating Peptides

In some embodiments, the delivery vehicles comprise cell penetrating peptides (CPPs). CPPs are short peptides that facilitate cellular uptake of various molecular cargo (e.g., from nanosized particles to small chemical molecules and large fragments of DNA).

CPPs may be of different sizes, amino acid sequences, and charges. In some examples, CPPs can translocate the plasma membrane and facilitate the delivery of various molecular cargoes to the cytoplasm or an organelle. CPPs may be introduced into cells via different mechanisms, e.g., direct penetration in the membrane, endocytosis-mediated entry, and translocation through the formation of a transitory structure.

CPPs may have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. Another type of CPPs is the trans-activating transcriptional activator (Tat) from Human Immunodeficiency Virus 1 (HIV-1). Examples of CPPs include to Penetratin, Tat (48-60), Transportan, and (R-AhX-R4) (Ahx refers to aminohexanoyl), Kaposi fibroblast growth factor (FGF) signal peptide sequence, integrin β3 signal peptide sequence, polyarginine peptide Args sequence, Guanine rich-molecular transporters, and sweet arrow peptide. Examples of CPPs and related applications also include those described in U.S. Pat. No. 8,372,951.

CPPs can be used for in vitro and ex vivo work quite readily, and extensive optimization for each cargo and cell type is usually required. In some examples, CPPs may be covalently attached to the Cas protein directly, which is then complexed with the gRNA and delivered to cells. In some examples, separate delivery of CPP-Cas and CPP-gRNA to multiple cells may be performed. CPP may also be used to delivery RNPs.

CPPs may be used to deliver the compositions and systems to plants. In some examples, CPPs may be used to deliver the components to plant protoplasts, which are then regenerated to plant cells and further to plants.

DNA Nanoclews

In some embodiments, the delivery vehicles comprise DNA nanoclews. A DNA nanoclew refers to a sphere-like structure of DNA (e.g., with a shape of a ball of yarn). The nanoclew may be synthesized by rolling circle amplification with palindromic sequences that aide in the self-assembly of the structure. The sphere may then be loaded with a payload. An example of DNA nanoclew is described in Sun W et al, J Am Chem Soc. 2014 Oct. 22; 136(42): 14722-5; and Sun W et al, Angew Chem Int Ed Engl. 2015 Oct. 5; 54(41): 12029-33. DNA nanoclew may have a palindromic sequences to be partially complementary to the gRNA within the Cas: gRNA ribonucleoprotein complex. A DNA nanoclew may be coated, e.g., coated with PEI to induce endosomal escape.

Metal Nanoparticles

In some embodiments, the delivery vehicles comprise gold nanoparticles (also referred to AuNPs or colloidal gold). Gold nanoparticles may form complex with cargos, e.g., Cas: gRNA RNP. Gold nanoparticles may be coated, e.g., coated in a silicate and an endosomal disruptive polymer, PAsp (DET). Examples of gold nanoparticles include AuraSense Therapeutics' Spherical Nucleic Acid (SNA™) constructs, and those described in Mout R, et al. (2017). ACS Nano 11:2452-8; Lee K, et al. (2017). Nat Biomed Eng 1:889-901. Other metal nanoparticles can also be complexed with cargo(s). Such metal particles include tungsten, palladium, rhodium, platinum, and iridium particles. Other non-limiting, exemplary metal nanoparticles are described in US20100129793.

iTOP

In some embodiments, the delivery vehicles comprise iTOP. iTOP refers to a combination of small molecules drives the highly efficient intracellular delivery of native proteins, independent of any transduction peptide. iTOP may be used for induced transduction by osmocytosis and pro-panebetaine, using NaCl-mediated hyperosmolality together with a transduction compound (propanebetaine) to trigger macropinocytotic uptake into cells of extracellular macromolecules. Examples of iTOP methods and reagents include those described in D'Astolfo D S, Pagliero R J, Pras A, et al. (2015). Cell 161:674-690.

Polymer-Based Particles

In some embodiments, the delivery vehicles may comprise polymer-based particles (e.g., nanoparticles). In some embodiments, the polymer-based particles may mimic a viral mechanism of membrane fusion. The polymer-based particles may be a synthetic copy of Influenza virus machinery and form transfection complexes with various types of nucleic acids ((siRNA, miRNA, plasmid DNA or shRNA, mRNA) that cells take up via the endocytosis pathway, a process that involves the formation of an acidic compartment. The low pH in late endosomes acts as a chemical switch that renders the particle surface hydrophobic and facilitates membrane crossing. Once in the cytosol, the particle releases its payload for cellular action. This Active Endosome Escape technology is safe and maximizes transfection efficiency as it is using a natural uptake pathway. In some embodiments, the polymer-based particles may comprise alkylated and carboxyalkylated branched polyethylenimine. In some examples, the polymer-based particles are VIROMER, e.g., VIROMER RNAi, VIROMER RED, VIROMER mRNA, VIROMER CRISPR. Example methods of delivering the systems and compositions herein include those described in Bawage S S et al., Synthetic mRNA expressed Cas13a mitigates RNA virus infections, www.biorxiv.org/content/10.1101/370460v1.full doi: doi.org/10.1101/370460, Viromer® RED, a powerful tool for transfection of keratinocytes. doi: 10.13140/RG.2.2.16993.61281, Viromer® Transfection—Factbook 2018: technology, product overview, users' data., doi: 10.13140/RG.2.2.23912.16642. Other exemplary and non-limiting polymeric particles are described in US20170079916, US 20160367686, US 20110212179, US 20130302401, U.S. Pat. Nos. 6,007,845, 5,855,913, 5,985,309, 5,543,158, WO2012135025, US 20130252281, US 20130245107, US 20130244279; US20050019923, 20080267903.

Streptolysin O (SLO)

The delivery vehicles may be streptolysin O (SLO). SLO is a toxin produced by Group A streptococci that works by creating pores in mammalian cell membranes. SLO may act in a reversible manner, which allows for the delivery of proteins (e.g., up to 100 kDa) to the cytosol of cells without compromising overall viability. Examples of SLO include those described in Sierig G, et al. (2003). Infect Immun 71:446-55; Walev I, et al. (2001). Proc Natl Acad Sci USA 98:3185-90; Teng K W, et al. (2017). Elife 6: e25460.

Multifunctional Envelope-Type Nanodevice (MEND)

The delivery vehicles may comprise multifunctional envelope-type nanodevice (MENDs). MENDs may comprise condensed plasmid DNA, a PLL core, and a lipid film shell. A MEND may further comprise cell-penetrating peptide (e.g., stearyl octaarginine). The cell penetrating peptide may be in the lipid shell. The lipid envelope may be modified with one or more functional components, e.g., one or more of: polyethylene glycol (e.g., to increase vascular circulation time), ligands for targeting of specific tissues/cells, additional cell-penetrating peptides (e.g., for greater cellular delivery), lipids to enhance endosomal escape, and nuclear delivery tags. In some examples, the MEND may be a tetra-lamellar MEND (T-MEND), which may target the cellular nucleus and mitochondria. In certain examples, a MEND may be a PEG-peptide-DOPE-conjugated MEND (PPD-MEND), which may target bladder cancer cells. Examples of MENDs include those described in Kogure K, et al. (2004). J Control Release 98:317-23; Nakamura T, et al. (2012). Acc Chem Res 45:1113-21.

Cargo Polynucleotides

The engineered muscle-specific delivery system polynucleotides, viral capsid polynucleotides, other AAV polynucleotide(s), and/or vector polynucleotides, virus particles, and/or non-vector delivery vehicles can contain one or more cargo polynucleotides. In some embodiments, the one or more cargo polynucleotides are operably linked to the engineered muscle-specific delivery system polynucleotides(s) and is, in some embodiments, be part of the engineered viral genome of an engineered viral system of the present invention. The cargo polynucleotides can be packaged into an engineered virus particle, which can be delivered to, e.g., a cell. In some embodiments, the cargo polynucleotide can be capable of modifying a polynucleotide (e.g. gene or transcript) of a cell to which it is delivered. In some embodiments, the cargo is a polynucleotide that encodes a replacement polypeptide to correct for a defective polypeptide. As used herein, "gene" can refer to a hereditary unit corresponding to a sequence of DNA that occupies a specific location on a chromosome and that contains the genetic instruction for a characteristic(s) or trait(s) in an organism. The term gene can refer to translated and/or untranslated regions of a genome. "Gene" can refer to the specific sequence of DNA that is transcribed into an RNA transcript that can be translated into a polypeptide or be a catalytic RNA molecule, including but not limited to, tRNA, siRNA, piRNA, miRNA, long-non-coding RNA and shRNA. Polynucleotide, gene, transcript, etc. modification includes all genetic engineering techniques including, but not limited to, gene editing as well as conventional recombinational gene modification techniques (e.g. whole or partial gene insertion, deletion, and mutagenesis (e.g. insertional and deletional mutagenesis) techniques.

In some embodiments, the cargo molecule is a polynucleotide that is or can encode a vaccine. In some embodiments, the vaccine can stimulate an immune response against a cancer. In some embodiments, the vaccine can stimulate an immune response against colorectal or pancreatic cancer. In some embodiments, the vaccine can create an unstable environment for hCG-producing cells, such as hCG producing cancer cells.

In some embodiments the cargo is a polynucleotide that itself or a product thereof can be effective to treat a muscle disease or a symptom thereof.

Gene Modification Cargo Polynucleotides

In some embodiments, the cargo molecule can be a polynucleotide or polypeptide that can alone or when delivered as part of a system, whether or not delivered with other components of the system, operate to modify the genome, epigenome, and/or transcriptome of a cell to which it is delivered. Such systems include, but are not limited to, CRISPR-Cas systems. Other gene modification systems, e.g. TALENs, Zinc Finger nucleases, Cre-Lox, morpholinos, etc. are other non-limiting examples of gene modification systems whose one or more components can be delivered by the engineered AAV particles described herein.

In some embodiments, the cargo molecule is a gene editing system or component thereof. In some embodiments, the cargo molecule is a CRISPR-Cas system molecule or a component thereof. In some embodiments, the cargo molecule is a polynucleotide that encodes one or more components of a gene modification system (such as a CRISPR-Cas system). In some embodiments, the cargo molecule is a gRNA.

In some embodiments, the cargo molecule can be a polynucleotide or polypeptide that can alone or when delivered as part of a system, whether or not delivered with other components of the system, operate to modify the genome, epigenome, and/or transcriptome of a cell to which it is delivered, is such that it treats or prevents a disease, a disorder, or a symptom thereof of a muscle or skeletal disorder, a neurologic disease or disorder, and/or viruses (such as single stranded RNA viruses). In some embodiments, the cargo molecule, whether or not delivered with other components of the system, operate to modify the genome, epigenome, and/or transcriptome of a cell to which it is delivered, is such that it treats or prevents, a progeroid disease (e.g. progeroid laminopathy) a glycogen storage disease an immune disorder (such as an autoimmune disease), a cancer, Duchenne muscular dystrophy (DMD), 6 Limb-girdle muscular dystrophy diseases (LGMD), Charcot-Marie-Tooth (CMT), MPS IIIA, Pompe disease, or other CNS-related diseases such as Huntington's and other expanded repeat diseases.

In some embodiments, the cargo molecule, whether or not delivered with other components of the system, operate to modify the genome, epigenome, and/or transcriptome of a cell to which it is delivered, is such that can modify the GAA gene, such as any of those described in US Pat. App. Pub. 20190284555, the contents of which are incorporated by reference as if expressed in their entirety herein and can be adapted for use with the present invention.

In some embodiments, the cargo molecule includes an oligonucleotide coupled to a MHCK7, CK8, or other muscle specific promoter.

In some embodiments, the cargo molecule is a microdystrophin oligonucleotide that contains only selected regions of the dystrophin gene optimized for protein functionality. In some embodiments, the selected regions include spectrin-like repeats 1, 2, 3, and 24. See e.g. Harper S Q, Hauser M A, DelloRusso C, et al. Modular flexibility of dystrophin: implications for gene therapy of Duchenne muscular dystrophy. Nat Med. 2002; 8(3): 253-261. In some embodiments, the micro-dystrophin oligonucleotide is that is delivered by the rAAV agent known as AAVrh74.MHCK7 microdystrophin gene or SRP-9001, which is subject to the clinical trials NCT03375164 and NCT03769116. This microdystrophin gene construct includes NT-H1-R1-R2-R3-H2-R24-H4-CR-CT. In some embodiments, the microdystrophin gene includes ABD-H1-R1-R2-R3-H2-R24-H4-CR-CT. In some embodiments, the microdystrophin gene includes H stands for hinge region. England S B, et al. Nature. 1990; 343(6254): 180-182; Wells D J, et al. Hum Mol Genet. 1995; 4(8): 1245-1250, Salva M Z, et al. Mol Ther. 2007; 15(2): 320-329; Mendell J R, et al. Neurosci Lett. 2012; 527(2): 90-99; Rodino-Klapac L R, et al. Hum Mol Genet. 2013; 22(24): 4929-4937; Velazquez V M, et al. Mol Ther Methods Clin Dev. 2017; 4:159-168; Harper S Q, et al. Nat Med. 2002; 8(3): 253-261; Nelson D M, et al. Hum Mol Genet. 2018; 27(12): 2090-2100. In some embodiments, the selected regions at least include spectrin-like repeats 2 and 3. In some embodiments, the micro-dystrophin gene contains a nNOS domain. In some embodiments, the nNOS domain is composed of spectrin-like repeats 16 and/or 17. In some embodiments, the micro-dystrophin gene includes spectrin-like repeats 16 and 17. In some embodiments, the nNOS domain is composed of spectrin-like repeats R1, R16, R17, R23, and R24. In some embodiments, the micro-dystrophin gene is coupled to a muscle specific promoter. In some embodiments, the micro-dystrophin oligonucleotide is coupled to a MHCK7, CK8, SNP18, SP0033, SP0051, SP0173, tmCK, or another muscle specific promoter.

In some embodiments, the cargo microdystrophin includes an ABD (actin binding domain), one or more hinge regions (e.g. H1, H2, H3, H4,), and one or more spectrin-like repeats (e.g. R1, R1' R2, R3, R16, R17, R20, R21, R22, R23, R24, R24' and optionally a dystroglycan binding domain (DBD). In some embodiments, the microdystrophin is composed of ABD-H1-R1-R16-R17-R23-R24-H4-DBD. In some embodiments, the microdystrophin is composed f ABD-H1-R1-R2-R3-H2-R24-H4-CR. In some embodiments, the microdystrophin gene includes ABD-H1-R1-R2-R3-H2-R24-H4-CR-CT. In some embodiments, the microdystrophin gene includes ABD-H1-R1'-R24'-H4-CR-CT.

In some embodiments, the cargo molecule is a polynucleotide that can encode a microdystrophin gene, where the microdystrophin gene contains spectrin-like repeats, R1, R16, R17, R23 and R24. In some embodiments, the microdystrophin gene contains hinge region (H) 4 and/or H1. In some embodiments, the microdystrophin gene contains the N-terminal actin binding domain. In some embodiments, the microdystrophin gene contains the C-terminal dystroglycan binding domain of the human full-length dystrophin protein. The micro-dystrophin gene can contain an nNOS domain. In some embodiments, the nNOS domain is composed of spectrin-like repeats 16 and/or 17. In some embodiments, the micro-dystrophin gene includes spectrin-like repeats 16 and 17. The microdystrophin gene can be as described in WO2019118806A1 and WO2016/115543, which are incorporated by reference as if expressed in their entirety herein and can be adapted for use with the present invention. In some embodiments, the cargo polynucleotide can encode a 5-repeat microdystrophin protein that contains, from N- to C-terminus, the N-terminal actin binding domain, Hinge region 1 (H1), spectrin-like repeats R1, R16, R17, R23, and R24, Hinge region 4 (H4), and the C-terminal dystroglycan binding domain of the human full-length dystrophin protein. The protein sequence of this 5-repeat microdystrophin and the related dystrophin minigene are described in WO2016/115543. In some embodiments, the cargo polynucleotide can correspond to a microdystrophin gene that is part of the agent known as SGT001 as currently in clinical trial having the identifier number NCT03368742.

In some embodiments, the cargo molecule is a minidys gene or vector. In some embodiments, the minidys gene or vector can be composed of ABD-H1-R1-R2-R3-R16-R17-H3-R20-R21; ABD-H1-R1-R2-R3-R16-R17-H3-R20-R21-R22-R23-R24-H4-CR; or H3-R20-R21-R22-R23-R24-H4-CR-CT.

In some embodiments, the cargo molecule is an SCGB cDNA. In some embodiments, the SGCB cDNA is coupled to a MHCK7, CK8 promoter, SNP18 promoter, SP0033 promoter, SP0051, SP0173 promoter, tmCK promoter or another muscle specific promoter. In some embodiments, the cargo molecule is a beta-sarcoglycan cDNA, an alpha-sarcoglycan cDNA, a dysferlin cDNA, a gamma-sarcoglycan cDNA, a Calpin-3 cDNA, a SGSH cDNA (e.g., LYS-SAF302), a neurotropin 3 cDNA, an anoctamin-5 cDNA, or any combination thereof.

In some embodiments, the cargo molecule, whether or not delivered with other components of the system, operate to modify the genome, epigenome, and/or transcriptome of a cell to which it is delivered, is such that treat, prevent, and/or modify a gene or gene product associated with an expanded repeat disease, such as Huntington's disease, such as those described in U.S. Pat. App. Pub. 20190100755, U.S. patent Ser. No. 10/066,228, the contents of which are incorporated by reference as if expressed in their entirety herein and can be adapted for use with the present invention.

In some embodiments, the cargo molecule is an antisense oligomer or RNA molecule, such as those described in U.S. Pat. App. Pub. US20160251398, US20150267202, US20190015440, US20140287983, US20180216111, WO/2017/062835, US20190177723, US20170051278, US20180271893, WO/2016/14965, U.S. patent Ser. No. 10/076,536, WO/2018/00580, WO/2018/11866, WO/2019/059973, the contents of which are incorporated by reference as if expressed in their entirety herein and can be adapted for use with the present invention.

In some embodiments, the cargo molecule, whether or not delivered with other components of the system, operate to modify the genome, epigenome, and/or transcriptome of a cell to which it is delivered, is such that it treats or prevents a single stranded RNA virus, such as influenza, West Nile Virus, SARS, Hepatitis C, dengue fever, Ebola, Marburg, and/or Calicivirus. In some embodiments the cargo molecule can be an antisense antiviral compound, such as any of those described in U.S. Pat. No. 8,703,735B2, the contents of which are incorporated by reference as if expressed in their entirety herein and can be adapted for use with the present invention.

Additional, exemplary genetic and gene associated diseases and genes capable of being modified by a cargo molecule described herein are listed elsewhere herein, see e.g. Tables A-B.

In some embodiments, the cargo molecule can add or modify a GALGT2 gene.

Instead of acting to resupply missing dystrophin, GALGT2 gene therapy fortifies the structural integrity of muscle in ways that compensate for the absence of dystrophin, by increasing expression of proteins not mutated or lost in the disease. GALGT2 offers the potential to treat DMD irrespective of specific dystrophin mutation, as well as having utility in other muscular dystrophies.

In some embodiments, the cargo molecule is a morpholino, such as in US20180161359, US 20190054113 the contents of which are incorporated by reference as if expressed in their entirety herein and can be adapted for use with the present invention. In some embodiments, the morpholino is a morpholino oligomer (PMO) or a peptide linked morpholino PPMO. PMO based platforms can be used to treat genetic diseases by altering mRNA transcription. PMOs are synthetic chemical structures modeled after the natural framework of RNA. While PMOs have the same nucleic acid bases found in RNA, they are bound to six-sided morpholine rings instead of five-sided ribose rings. In addition, the morpholine rings are connected to each other by phosphorodiamidate linkages instead of the phosphodiester linkages found in RNA. PMOs and PPMOs can be used for exon skipping and translation suppression.

In some embodiments, the cargo molecule can be a peptide-oligomer, conjugate as described in e.g. WO2017106304A1, the contents of which are incorporated by reference as if expressed in their entirety herein and can be adapted for use with the present invention.

In some embodiments, the morpholino is the morpholino found in Eteplirsen, which can be effective to target Exon 51 of the dystrophin mRNA. In some embodiments, the cargo molecule can generate exon skipping in the context of DMD, such as those described in e.g. US20140315977A1, US2018010581, the contents of which are incorporated by reference as if expressed in their entirety herein and can be adapted for use with the present invention.

Exon Skipping

In some embodiments, the nucleotide sequences may encode nucleic acids capable of inducing exon skipping. Such encoded nucleic acids may be antisense oligonucleotides or antisense nucleotide systems. As used herein, the term "exon skipping" refers to the modification of pre-mRNA splicing by the targeting of splice donor and/or acceptor sites within a pre-mRNA with one or more complementary antisense oligonucleotide(s) (AONs). By blocking access of a spliceosome to one or more splice donor or acceptor site, an AON may prevent a splicing reaction thereby causing the deletion of one or more exons from a fully-processed mRNA. Exon skipping may be achieved in the nucleus during the maturation process of pre-mRNAs. In some examples, exon skipping may include the masking of key sequences involved in the splicing of targeted exons by using antisense oligonucleotides (AON) that are complementary to splice donor sequences within a pre-mRNA.

In some embodiments, the nucleotide sequences encode antisense oligonucleotides or antisense nucleotide systems capable of inducing exon skipping in dystrophin mRNA. For example, a non-sense or frameshift mutation within exon x of a dystrophin gene yields a carboxy-terminally truncated, non-functional dystrophin protein. The expression of that mature mRNA transcript may yield a functional dystrophin protein that is deleted in the amino acids encoded by exon x but that includes dystrophin amino acids both N-terminal and C-terminal to those deleted amino acids.

The nucleotide sequences may encode antisense oligonucleotides or antisense nucleotide systems capable of inducing exon skipping at exon 1, 2, 3, 4, 5, 6, 7, 8, 10, 11, 12, 13, 14, 15, 16, 17, 18, 19, 20, 21, 22, 23, 24, 25, 26, 27, 28, 29, 30, 31, 32, 33, 34, 45, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or any combination thereof. In some embodiments, nucleotide sequences may encode antisense oligonucleotides or antisense nucleotide systems capable of inducing exon skipping at exon 43, 44, 50, 51, 52, 55, or any combination thereof.

CRISPR-Cas System Cargo Molecules

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). See, e.g., Shmakov et al. (2015) "Discovery and Functional Characterization of Diverse Class 2 CRISPR-Cas Systems", Molecular Cell, DOI: dx.doi.org/10.1016/j.molcel.2015.10.008.

Class 1 Systems

The methods, systems, and tools provided herein may be designed for use with Class 1 CRISPR proteins. In certain example embodiments, the Class 1 system may be Type I, Type III or Type IV Cas proteins as described in Makarova et al. "Evolutionary classification of CRISPR-Cas systems: a burst of class 2 and derived variants" Nature Reviews Microbiology, 18:67-81 (February 2020)., incorporated in its entirety herein by reference, and particularly as described in FIG. 1, p. 326. The Class 1 systems typically use a multi-protein effector complex, which can, in some embodiments, include ancillary proteins, such as one or more proteins in a complex referred to as a CRISPR-associated complex for antiviral defense (Cascade), one or more adaptation proteins (e.g. Cas1, Cas2, RNA nuclease), and/or one or more accessory proteins (e.g. Cas 4, DNA nuclease), CRISPR associated Rossman fold (CARF) domain containing proteins, and/or RNA transcriptase. Although Class 1 systems have limited sequence similarity, Class 1 system proteins can be identified by their similar architectures, including one or more Repeat Associated Mysterious Protein (RAMP) family subunits, e.g. Cas 5, Cas6, Cas7. RAMP proteins are characterized by having one or more RNA recognition motif domains. Large subunits (for example cas8 or cas10) and small subunits (for example, cas11) are also typical of Class 1 systems. See, e.g., FIGS. 1 and 2. Koonin E V, Makarova K S. 2019 Origins and evolution of CRISPR-Cas systems. Phil. Trans. R. Soc. B 374:20180087, DOI: 10.1098/rstb.2018.0087. In one aspect, Class 1 systems are characterized by the signature protein Cas3. The Cascade in particular Class1 proteins can comprise a dedicated complex of multiple Cas proteins that binds pre-crRNA and recruits an additional Cas protein, for example Cas6 or Cas5, which is the nuclease directly responsible for processing pre-crRNA. In one aspect, the Type I CRISPR protein comprises an effector complex comprises one or more Cas5 subunits and two or more Cas7 subunits. Class 1 subtypes include Type I-A, I-B, I-C, I-U, I-D, I-E, and I-F, Type IV-A and IV-B, and Type III-A, III-D, III-C, and III-B. Class 1 systems also include CRISPR-Cas variants, including Type I-A, I-B, I-E, I-F and I-U variants, which can include variants carried by transposons and plasmids, including versions of subtype I-F encoded by a large family of Tn7-like transposon and smaller groups of Tn7-like transposons that encode similarly degraded subtype I-B systems. Peters et al., PNAS 114 (35) (2017); DOI: 10.1073/pnas. 1709035114; see also, Makarova et al, the CRISPR Journal, v. 1, n5, FIG. 5.

Class 2 Systems

The compositions, systems, and methods described in greater detail elsewhere herein can be designed and adapted for use with Class 2 CRISPR-Cas systems. Thus, in some embodiments, the CRISPR-Cas system is a Class 2 CRISPR-Cas system. Class 2 systems are distinguished from Class 1 systems in that they have a single, large, multi-domain effector protein. In certain example embodiments, the Class 2 system can be a Type II, Type V, or Type VI system, which are described in Makarova et al. "Evolutionary classification of CRISPR-Cas systems: a burst of class 2 and derived variants" Nature Reviews Microbiology, 18:67-81 (February 2020), incorporated herein by reference. Each type of Class 2 system is further divided into subtypes. See Markova et al. 2020, particularly at Figure. 2. Class 2, Type II systems can be divided into 4 subtypes: II-A, II-B, II-C1, and II-C2. Class 2, Type V systems can be divided into 17 subtypes: V-A, V-B1, V-B2, V-C, V-D, V-E, V-F1, V-F1 (V-U3), V-F2, V-F3, V-G, V-H, V-I, V-K (V-U5), V-U1, V-U2, and V-U4. Class 2, Type IV systems can be divided into 5 subtypes: VI-A, VI-B1, VI-B2, VI-C, and VI-D.

The distinguishing feature of these types is that their effector complexes consist of a single, large, multi-domain protein. Type V systems differ from Type II effectors (e.g., Cas9), which contain two nuclear domains that are each responsible for the cleavage of one strand of the target DNA, with the HNH nuclease inserted inside the RuvC-like nuclease domain sequence. The Type V systems (e.g., Cas12) only contain a RuvC-like nuclease domain that cleaves both strands. Type VI (Cas13) are unrelated to the effectors of Type II and V systems and contain two HEPN domains and target RNA. Cas13 proteins also display collateral activity that is triggered by target recognition. Some Type V systems have also been found to possess this collateral activity with two single-stranded DNA in in vitro contexts.

In some embodiments, the Class 2 system is a Type II system. In some embodiments, the Type II CRISPR-Cas system is a II-A CRISPR-Cas system. In some embodiments, the Type II CRISPR-Cas system is a II-B CRISPR-Cas system. In some embodiments, the Type II CRISPR-Cas system is a II-C1 CRISPR-Cas system. In some embodiments, the Type II CRISPR-Cas system is a II-C2 CRISPR-Cas system. In some embodiments, the Type II system is a Cas9 system. In some embodiments, the Type II system includes a Cas9.

In some embodiments, the Class 2 system is a Type V system. In some embodiments, the Type V CRISPR-Cas system is a V-A CRISPR-Cas system. In some embodiments, the Type V CRISPR-Cas system is a V-B1 CRISPR-Cas system. In some embodiments, the Type V CRISPR-Cas system is a V-B2 CRISPR-Cas system. In some embodiments, the Type V CRISPR-Cas system is a V-C CRISPR-Cas system. In some embodiments, the Type V CRISPR-Cas system is a V-D CRISPR-Cas system. In some embodiments, the Type V CRISPR-Cas system is a V-E CRISPR-Cas system. In some embodiments, the Type V CRISPR-Cas system is a V-F1 CRISPR-Cas system. In some embodiments, the Type V CRISPR-Cas system is a V-F1 (V-U3) CRISPR-Cas system. In some embodiments, the Type V CRISPR-Cas system is a V-F2 CRISPR-Cas system. In some embodiments, the Type V CRISPR-Cas system is a V-F3 CRISPR-Cas system. In some embodiments, the Type V CRISPR-Cas system is a V-G CRISPR-Cas system. In some embodiments, the Type V CRISPR-Cas system is a V-H CRISPR-Cas system. In some embodiments, the Type V CRISPR-Cas system is a V-I CRISPR-Cas system. In some embodiments, the Type V CRISPR-Cas system is a V-K (V-U5) CRISPR-Cas system. In some embodiments, the Type V CRISPR-Cas system is a V-U1 CRISPR-Cas system. In some embodiments, the Type V CRISPR-Cas system is a V-U2 CRISPR-Cas system. In some embodiments, the Type V CRISPR-Cas system is a V-U4 CRISPR-Cas system. In some embodiments, the Type V CRISPR-Cas system includes a Cas12a (Cpf1), Cas12b (C2c1), Cas12c (C2c3), Cas12d (CasY), Cas12e (CasX), Cas14, and/or CasΦ.

In some embodiments, the Class 2 system is a Type VI system. In some embodiments, the Type VI CRISPR-Cas system is a VI-A CRISPR-Cas system. In some embodiments, the Type VI CRISPR-Cas system is a VI-B1 CRISPR-Cas system. In some embodiments, the Type VI CRISPR-Cas system is a VI-B2 CRISPR-Cas system. In some embodiments, the Type VI CRISPR-Cas system is a VI-C CRISPR-Cas system. In some embodiments, the Type VI CRISPR-Cas system is a VI-D CRISPR-Cas system. In some embodiments, the Type VI CRISPR-Cas system includes a Cas13a (C2c2), Cas13b (Group 29/30), Cas13c, and/or Cas13d.

Cas Molecules

In some embodiments, the cargo molecule can be or include a Cas polypeptide and/or a polynucleotide that can encode a Cas polypeptide or a fragment thereof. Any Cas molecule can be a cargo molecule. In some embodiments, the cargo molecule is Class I CRISPR-Cas system Cas polypeptide. In some embodiments, the cargo molecule is a Class II CRISPR-Cas system Cas polypeptide. In some embodiments, the Cas polypeptide is a Type I Cas polypeptides. In some embodiments, the Cas polypeptide is a Type II Cas polypeptides. In some embodiments, the Cas polypeptides is a Type III Cas polypeptide. In some embodiments, the Cas polypeptides is a Type IV Cas polypeptide. In some embodiments, the Cas polypeptides is a Type V Cas polypeptide. In some embodiments, the Cas polypeptides is a Type VI Cas polypeptide. In some embodiments, the Cas polypeptides is a Type VII Cas polypeptide. Non-limiting examples of Cas proteins include Cas1, Cas1B, Cas2, Cas3, Cas4, Cas5, Cas6, Cas7, Cas8, Cas9 (also known as Csn1 and Csx12), Cas10, Cas 12, Cas 12a, Cas 13a, Cas 13b, Cas 13c, Cas 13d, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. Other suitable Cas proteins or encoding polynucleotides that can be included as cargo are described elsewhere herein such as with discussion related to CRISPR-Cas systems.

Specialized Cas-Based Systems

In some embodiments, the system is a Cas-based system that is capable of performing a specialized function or activity. For example, the Cas protein may be fused, operably coupled to, or otherwise associated with one or more functionals domains. In certain example embodiments, the Cas protein may be a catalytically dead Cas protein ("dCas") and/or have nickase activity. A nickase is a Cas protein that cuts only one strand of a double stranded target. In such embodiments, the dCas or nickase provide a sequence specific targeting functionality that delivers the functional domain to or proximate a target sequence. Example functional domains that may be fused to, operably coupled to, or otherwise associated with a Cas protein can be or include, but are not limited to a nuclear localization signal (NLS) domain, a nuclear export signal (NES) domain, a translational activation domain, a transcriptional activation domain (e.g. VP64, p65, MyoD1, HSF1, RTA, and SET7/9), a translation initiation domain, a transcriptional repression domain (e.g., a KRAB domain, NuE domain, NcoR domain, and a SID domain such as a SID4X domain), a nuclease domain (e.g., FokI), a histone modification domain (e.g., a histone acetyltransferase), a light inducible/controllable domain, a chemically inducible/controllable domain, a transposase domain, a homologous recombination machinery domain, a recombinase domain, an integrase domain, and combinations thereof. Methods for generating catalytically dead Cas9 or a nickase Cas9 (International Patent Publication No. WO 2014/204725, Ran et al. Cell. 2013 Sep. 12; 154(6): 1380-1389), Cas12 (Liu et al. Nature Communications, 8, 2095 (2017), and Cas13 (International Patent Publication Nos. WO 2019/005884 and WO2019/060746) are known in the art and incorporated herein by reference.

In some embodiments, the functional domains can have one or more of the following activities: methylase activity, demethylase activity, translation activation activity, translation initiation activity, translation repression activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity, molecular switch activity, chemical inducibility, light inducibility, and nucleic acid binding activity. In some embodiments, the one or more functional domains may comprise epitope tags or reporters. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporters include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and auto-fluorescent proteins including blue fluorescent protein (BFP).

The one or more functional domain(s) may be positioned at, near, and/or in proximity to a terminus of the effector protein (e.g., a Cas protein). In embodiments having two or more functional domains, each of the two can be positioned at or near or in proximity to a terminus of the effector protein (e.g., a Cas protein). In some embodiments, such as those where the functional domain is operably coupled to the effector protein, the one or more functional domains can be tethered or linked via a suitable linker (including, but not limited to, GlySer linkers) to the effector protein (e.g., a Cas protein). When there is more than one functional domain, the functional domains can be same or different. In some embodiments, all the functional domains are the same. In some embodiments, all of the functional domains are different from each other. In some embodiments, at least two of the functional domains are different from each other. In some embodiments, at least two of the functional domains are the same as each other.

Other suitable functional domains can be found, for example, in International Patent Publication No. WO 2019/018423.

Split CRISPR-Cas Systems

In some embodiments, the CRISPR-Cas system is a split CRISPR-Cas system. See e.g., Zetche et al., 2015. Nat. Biotechnol. 33(2): 139-142 and International Patent Publication WO 2019/018423, the compositions and techniques of which can be used in and/or adapted for use with the present invention. Split CRISPR-Cas proteins are set forth herein and in documents incorporated herein by reference in further detail herein. In certain embodiments, each part of a split CRISPR protein are attached to a member of a specific binding pair, and when bound with each other, the members of the specific binding pair maintain the parts of the CRISPR protein in proximity. In certain embodiments, each part of a split CRISPR protein is associated with an inducible binding pair. An inducible binding pair is one which is capable of being switched "on" or "off" by a protein or small molecule that binds to both members of the inducible binding pair. In some embodiments, CRISPR proteins may preferably split between domains, leaving domains intact. In particular embodiments, said Cas split domains (e.g., RuvC and HNH domains in the case of Cas9) can be simultaneously or sequentially introduced into the cell such that said split Cas domain(s) process the target nucleic acid sequence in the algae cell. The reduced size of the split Cas compared to the wild type Cas allows other methods of delivery of the systems to the cells, such as the use of cell penetrating peptides as described herein.

DNA and RNA Base Editing

In some embodiments, a polynucleotide of the present invention described elsewhere herein can be modified using a base editing system. In some embodiments, a Cas protein is connected or fused to a nucleotide deaminase. Thus, in some embodiments the Cas-based system can be a base editing system. As used herein, "base editing" refers generally to the process of polynucleotide modification via a CRISPR-Cas-based or Cas-based system that does not include excising nucleotides to make the modification. Base editing can convert base pairs at precise locations without generating excess undesired editing byproducts that can be made using traditional CRISPR-Cas systems.

In certain example embodiments, the nucleotide deaminase may be a DNA base editor used in combination with a DNA binding Cas protein such as, but not limited to, Class 2 Type II and Type V systems. Two classes of DNA base editors are generally known: cytosine base editors (CBEs) and adenine base editors (ABEs). CBEs convert a C·G base pair into a T·A base pair (Komor et al. 2016. Nature. 533:420-424; Nishida et al. 2016. Science. 353; and Li et al. Nat. Biotech. 36:324-327) and ABEs convert an A·T base pair to a G·C base pair. Collectively, CBEs and ABEs can mediate all four possible transition mutations (C to T, A to G, T to C, and G to A). Rees and Liu. 2018. Nat. Rev. Genet. 19(12): 770-788, particularly at FIGS. 1b, 2a-2c, 3a-3f, and Table 1. In some embodiments, the base editing system includes a CBE and/or an ABE. In some embodiments, a polynucleotide of the present invention described elsewhere herein can be modified using a base editing system. Rees and Liu. 2018. Nat. Rev. Gent. 19(12): 770-788. Base editors also generally do not need a DNA donor template and/or rely on homology-directed repair. Komor et al. 2016. Nature. 533:420-424; Nishida et al. 2016. Science. 353; and Gaudeli et al. 2017. Nature. 551:464-471. Upon binding to a target locus in the DNA, base pairing between the guide RNA of the system and the target DNA strand leads to displacement of a small segment of ssDNA in an "R-loop". Nishimasu et al. Cell. 156:935-949. DNA bases within the ssDNA bubble are modified by the enzyme component, such as a deaminase. In some systems, the catalytically disabled Cas protein can be a variant or modified Cas can have nickase functionality and can generate a nick in the non-edited DNA strand to induce cells to repair the non-edited strand using the edited strand as a template. Komor et al. 2016. Nature. 533:420-424; Nishida et al. 2016. Science. 353; and Gaudeli et al. 2017. Nature. 551:464-471.

Other Example Type V base editing systems are described in International Patent Publication Nos. WO 2018/213708, WO 2018/213726, and International Patent Applications No. PCT/US2018/067207, PCT/US2018/067225, and PCT/US2018/067307, each of which is incorporated herein by reference.

In certain example embodiments, the base editing system may be an RNA base editing system. As with DNA base editors, a nucleotide deaminase capable of converting nucleotide bases may be fused to a Cas protein. However, in these embodiments, the Cas protein will need to be capable of binding RNA. Example RNA binding Cas proteins include, but are not limited to, RNA-binding Cas9s such as *Francisella novicida* Cas9 ("FnCas9"), and Class 2 Type VI Cas systems. The nucleotide deaminase may be a cytidine deaminase or an adenosine deaminase, or an adenosine deaminase engineered to have cytidine deaminase activity. In certain example embodiments, the RNA base editor may be used to delete or introduce a post-translation modification site in the expressed mRNA. In contrast to DNA base editors, whose edits are permanent in the modified cell, RNA base editors can provide edits where finer, temporal control may be needed, for example in modulating a particular immune response. Example Type VI RNA-base editing systems are described in Cox et al. 2017. Science 358:1019-1027, International Patent Publication Nos. WO 2019/005884, WO 2019/005886, and WO 2019/071048, and International Patent Application Nos. PCT/US20018/05179 and PCT/US2018/067207, which are incorporated herein by reference. An example FnCas9 system that may be adapted for RNA base editing purposes is described in International Patent Publication No. WO 2016/106236, which is incorporated herein by reference.

An example method for delivery of base-editing systems, including use of a split-intein approach to divide CBE and ABE into reconstitutable halves, is described in Levy et al. Nature Biomedical Engineering doi.org/10.1038/s41441-019-0505-5(2019), which is incorporated herein by reference.

Prime Editors

In some embodiments, a polynucleotide of the present invention described elsewhere herein can be modified using a prime editing system. See e.g. Anzalone et al. 2019. Nature. 576:149-157. Like base editing systems, prime editing systems can be capable of targeted modification of a polynucleotide without generating double stranded breaks and does not require donor templates. Further prime editing systems can be capable of all 12 possible combination swaps. Prime editing can operate via a "search-and-replace" methodology and can mediate targeted insertions, deletions, all 12 possible base-to-base conversion and combinations thereof. Generally, a prime editing system, as exemplified by PE1, PE2, and PE3 (Id.), can include a reverse transcriptase fused or otherwise coupled or associated with an RNA-programmable nickase and a prime-editing extended guide RNA (pegRNA) to facility direct copying of genetic information from the extension on the pegRNA into the target polynucleotide. Embodiments that can be used with the present invention include these and variants thereof. Prime editing can have the advantage of lower off-target activity than traditional CRISPR-Cas systems along with few byproducts and greater or similar efficiency as compared to traditional CRISPR-Cas systems.

In some embodiments, the prime editing guide molecule can specify both the target polynucleotide information (e.g., sequence) and contain a new polynucleotide cargo that replaces target polynucleotides. To initiate transfer from the guide molecule to the target polynucleotide, the PE system can nick the target polynucleotide at a target side to expose a 3'hydroxyl group, which can prime reverse transcription of an edit-encoding extension region of the guide molecule (e.g. a prime editing guide molecule or peg guide molecule) directly into the target site in the target polynucleotide. See e.g. Anzalone et al. 2019. Nature. 576:149-157, particularly at FIGS. 1*b*, 1*c*, related discussion, and Supplementary discussion.

In some embodiments, a prime editing system can be composed of a Cas polypeptide having nickase activity, a reverse transcriptase, and a guide molecule. The Cas polypeptide can lack nuclease activity. The guide molecule can include a target binding sequence as well as a primer binding sequence and a template containing the edited polynucleotide sequence. The guide molecule, Cas polypeptide, and/ or reverse transcriptase can be coupled together or otherwise associate with each other to form an effector complex and edit a target sequence. In some embodiments, the Cas polypeptide is a Class 2, Type V Cas polypeptide. In some embodiments, the Cas polypeptide is a Cas9 polypeptide (e.g. is a Cas9 nickase). In some embodiments, the Cas polypeptide is fused to the reverse transcriptase. In some embodiments, the Cas polypeptide is linked to the reverse transcriptase.

In some embodiments, the prime editing system can be a PEI system or variant thereof, a PE2 system or variant thereof, or a PE3 (e.g. PE3, PE3b) system. See e.g., Anzalone et al. 2019. Nature. 576:149-157, particularly at pgs. 2-3, FIGS. 2*a*, 3*a*-3*f*, 4*a*-4*b*, Extended data FIGS. 3*a*-3*b*, and 4.

The peg guide molecule can be about 10 to about 200 or more nucleotides in length, such as 10 to/or 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or 200 or more nucleotides in length. Optimization of the peg guide molecule can be accomplished as described in Anzalone et al. 2019. Nature. 576:149-157, particularly at pg. 3, FIG. 2*a*-2*b*, and Extended Data FIGS. 5*a*-*c*.

CRISPR Associated Transposase (CAST) Systems

In some embodiments, a polynucleotide of the present invention described elsewhere herein can be modified using a CRISPR Associated Transposase ("CAST") system. CAST system can include a Cas protein that is catalytically inactive, or engineered to be catalytically active, and further comprises a transposase (or subunits thereof) that catalyze RNA-guided DNA transposition. Such systems are able to insert DNA sequences at a target site in a DNA molecule without relying on host cell repair machinery. CAST systems can be Class1 or Class 2 CAST systems. An example Class 1 system is described in Klompe et al. Nature, doi: 10.1038/s41586-019-1323, which is in incorporated herein by reference. An example Class 2 system is described in Strecker et al. Science. 10/1126/science. aax9181 (2019), and PCT/US2019/066835 which are incorporated herein by reference.

Guide Sequences

In some embodiments, the cargo is or includes one or more guide molecules for a CRISPR-Cas system. The terms guide molecule, guide sequence and guide polynucleotide refer to polynucleotides capable of guiding Cas to a target genomic locus and are used interchangeably as in foregoing cited documents such as International Patent Publication No. WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. The guide molecule can be a polynucleotide.

The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay (Qui et al. 2004. BioTechniques. 36(4) 702-707). Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible and will occur to those skilled in the art.

In some embodiments, the guide molecule is an RNA. The guide molecule(s) (also referred to interchangeably herein as guide polynucleotide and guide sequence) that are included in the CRISPR-Cas or Cas based system can be any polynucleotide sequence having sufficient complementarity with a target nucleic acid sequence to hybridize with the target nucleic acid sequence and direct sequence-specific binding of a nucleic acid-targeting complex to the target nucleic acid sequence. In some embodiments, the degree of complementarity, when optimally aligned using a suitable alignment algorithm, can be about or more than about 50%, 60%, 75%, 80%, 85%, 90%, 95%, 97.5%, 99%, or more. Optimal alignment may be determined with the use of any suitable algorithm for aligning sequences, non-limiting examples of which include the Smith-Waterman algorithm, the Needleman-Wunsch algorithm, algorithms based on the Burrows-Wheeler Transform (e.g., the Burrows Wheeler Aligner), Clustal W, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net).

A guide sequence, and hence a nucleic acid-targeting guide, may be selected to target any target nucleic acid sequence. The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (RNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide is selected to reduce the degree secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9(1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27 to 30 nt, e.g., 27, 28, 29, or 30 nt, from 30 to 35 nt, e.g., 30, 31, 32, 33, 34, or 35 nt, or 35 nt or longer.

The "tracrRNA" sequence or analogous terms includes any polynucleotide sequence that has sufficient complementarity with a crRNA sequence to hybridize. In some embodiments, the degree of complementarity between the tracrRNA sequence and crRNA sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and crRNA sequence are contained within a single transcript, such that hybridization between the two produces a transcript having a secondary structure, such as a hairpin.

In general, degree of complementarity is with reference to the optimal alignment of the sca sequence and tracr sequence, along the length of the shorter of the two sequences. Optimal alignment may be determined by any suitable alignment algorithm and may further account for secondary structures, such as self-complementarity within either the sca sequence or tracr sequence. In some embodiments, the degree of complementarity between the tracr sequence and sca sequence along the length of the shorter of the two when optimally aligned is about or more than about 25%, 30%, 40%, 50%, 60%, 70%, 80%, 90%, 95%, 97.5%, 99%, or higher.

In some embodiments, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and tracr RNA can be 30 or 50 nucleotides in length. In some embodiments, the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it being advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In some embodiments according to the invention, the guide RNA (capable of guiding Cas to a target locus) may comprise (1) a guide sequence capable of hybridizing to a genomic target locus in the eukaryotic cell; (2) a tracr sequence; and (3) a tracr mate sequence. All (1) to (3) may reside in a single RNA, i.e., an sgRNA (arranged in a 5' to 3' orientation), or the tracr RNA may be a different RNA than the RNA containing the guide and tracr sequence. The tracr hybridizes to the tracr mate sequence and directs the CRISPR/Cas complex to the target sequence. Where the tracr RNA is on a different RNA than the RNA containing the guide and tracr sequence, the length of each RNA may be optimized to be shortened from their respective native lengths, and each may be independently chemically modified to protect from degradation by cellular RNase or otherwise increase stability.

Many modifications to guide sequences are known in the art and are further contemplated within the context of this invention. Various modifications may be used to increase the specificity of binding to the target sequence and/or increase the activity of the Cas protein and/or reduce off-target effects. Example guide sequence modifications are described in International Patent Application No. PCT US2019/045582, specifically paragraphs [0178]-[0333], which is incorporated herein by reference.

Target Sequences, PAMs, and PES's
Target Sequences

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target polynucleotide can be a polynucleotide or a part of a polynucleotide to which a part of the guide sequence is designed to have complementarity with and to which the effector function mediated by the complex comprising the CRISPR effector protein and a guide molecule is to be directed. In some embodiments, a target sequence is located in the nucleus or cytoplasm of a cell.

The guide sequence can specifically bind a target sequence in a target polynucleotide. The target polynucleotide may be DNA. The target polynucleotide may be RNA. The target polynucleotide can have one or more (e.g., 1, 2, 3, 4, 5, 6, 7, 8, 9, 10, etc. or more) target sequences. The target polynucleotide can be on a vector. The target polynucleotide can be genomic DNA. The target polynucleotide can be episomal. Other forms of the target polynucleotide are described elsewhere herein.

The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence (also referred to herein as a target polynucleotide) may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

PAM and PFS Elements

PAM elements are sequences that can be recognized and bound by Cas proteins. Cas proteins/effector complexes can then unwind the dsDNA at a position adjacent to the PAM element. It will be appreciated that Cas proteins and systems that include them that target RNA do not require PAM sequences (Marraffini et al. 2010. Nature. 463:568-571). Instead, many rely on PFSs, which are discussed elsewhere herein. In certain embodiments, the target sequence should be associated with a PAM (protospacer adjacent motif) or PFS (protospacer flanking sequence or site), that is, a short sequence recognized by the CRISPR complex. Depending on the nature of the CRISPR-Cas protein, the target sequence should be selected, such that its complementary sequence in the DNA duplex (also referred to herein as the non-target sequence) is upstream or downstream of the PAM. In the embodiments, the complementary sequence of the target sequence is downstream or 3' of the PAM or upstream or 5' of the PAM. The precise sequence and length requirements for the PAM differ depending on the Cas protein used, but PAMs are typically 2-5 base pair sequences adjacent the protospacer (that is, the target sequence). Examples of the natural PAM sequences for different Cas proteins are provided herein below and the skilled person will be able to identify further PAM sequences for use with a given Cas protein.

The ability to recognize different PAM sequences depends on the Cas polypeptide(s) included in the system. See e.g., Gleditzsch et al. 2019. RNA Biology. 16(4): 504-517. Table 10 (from Gleditzsch et al. 2019) below shows several Cas polypeptides and the PAM sequence they recognize.

TABLE 10

Example PAM Sequences

| Cas Protein | PAM Sequence |
|---|---|
| SpCas9 | NGG/NRG |
| SaCas9 | NGRRT or NGRRN |
| NmeCas9 | NNNNGATT |
| CjCas9 | NNNNRYAC |
| StCas9 | NNAGAAW |
| Cas12a (Cpf1) (including LbCpf1 and AsCpf1) | TTTV |
| Cas12b (C2c1) | TTT, TTA, and TTC |
| Cas12c (C2c3) | TA |
| Cas12d (CasY) | TA |
| Cas12e (CasX) | 5'-TTCN-3' |

In a preferred embodiment, the CRISPR effector protein may recognize a 3' PAM. In certain embodiments, the CRISPR effector protein may recognize a 3' PAM which is 5'H, wherein His A, C or U.

Further, engineering of the PAM Interacting (PI) domain on the Cas protein may allow programing of PAM specificity, improve target site recognition fidelity, and increase the versatility of the CRISPR-Cas protein, for example as described for Cas9 in Kleinstiver B P et al. Engineered CRISPR-Cas9 nucleases with altered PAM specificities. Nature. 2015 Jul. 23; 523(7561): 481-5. doi: 10.1038/nature14592. As further detailed herein, the skilled person will understand that Cas13 proteins may be modified analogously. Gao et al, "Engineered Cpf1 Enzymes with Altered PAM Specificities," bioRxiv 091611; doi: dx.doi.org/10.1101/091611 (Dec. 4, 2016). Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

PAM sequences can be identified in a polynucleotide using an appropriate design tool, which are commercially available as well as online. Such freely available tools include, but are not limited to, CRISPRFinder and CRISPRTarget. Mojica et al. 2009. Microbiol. 155 (Pt. 3): 733-740; Atschul et al. 1990. J. Mol. Biol. 215:403-410; Biswass et al. 2013 RNA Biol. 10:817-827; and Grissa et al. 2007. Nucleic Acid Res. 35: W52-57. Experimental approaches to PAM identification can include, but are not limited to, plasmid depletion assays (Jiang et al. 2013. Nat. Biotechnol. 31:233-239; Esvelt et al. 2013. Nat. Methods. 10:1116-1121; Kleinstiver et al. 2015. Nature. 523:481-485), screened by a high-throughput in vivo model called PAM-SCNAR (Pattanayak et al. 2013. Nat. Biotechnol. 31:839-843 and Leenay et al. 2016.Mol. Cell. 16:253), and negative screening (Zetsche et al. 2015. Cell. 163:759-771).

As previously mentioned, CRISPR-Cas systems that target RNA do not typically rely on PAM sequences. Instead such systems typically recognize protospacer flanking sites (PFSs) instead of PAMs Thus, Type VI CRISPR-Cas systems typically recognize protospacer flanking sites (PFSs) instead of PAMs. PFSs represents an analogue to PAMs for RNA targets. Type VI CRISPR-Cas systems employ a Cas13. Some Cas13 proteins analyzed to date, such as Cas13a (C2c2) identified from Leptotrichia shahii (LShCAs13a) have a specific discrimination against G at the 3'end of the target RNA. The presence of a C at the corresponding crRNA repeat site can indicate that nucleotide pairing at this position is rejected. However, some Cas13 proteins (e.g., LwaCAs13a and PspCas13b) do not seem to have a PFS preference. See e.g., Gleditzsch et al. 2019. RNA Biology. 16(4): 504-517.

Some Type VI proteins, such as subtype B, have 5'-recognition of D (G, T, A) and a 3'-motif requirement of NAN or NNA. One example is the Cas13b protein identified in Bergeyella zoohelcum (BzCas13b). See e.g., Gleditzsch et al. 2019. RNA Biology. 16(4): 504-517.

Overall Type VI CRISPR-Cas systems appear to have less restrictive rules for substrate (e.g., target sequence) recognition than those that target DNA (e.g., Type V and type II).

Sequences Related to Nucleus Targeting and Transportation

In some embodiments, one or more components (e.g., the Cas protein and/or deaminase) in the composition for engineering cells may comprise one or more sequences related to nucleus targeting and transportation. Such sequence may facilitate the one or more components in the composition for targeting a sequence within a cell. In order to improve targeting of the CRISPR-Cas protein and/or the nucleotide deaminase protein or catalytic domain thereof used in the methods of the present disclosure to the nucleus, it may be advantageous to provide one or both of these components with one or more nuclear localization sequences (NLSs).

In some embodiments, the NLSs used in the context of the present disclosure are heterologous to the proteins. Non-limiting examples of NLSs include an NLS sequence derived from: the NLS of the SV40 virus large T-antigen, having the amino acid sequence PKKKRKV (SEQ ID NO: 52) or PKKKRKVEAS (SEQ ID NO: 53); the NLS from nucleoplasmin (e.g., the nucleoplasmin bipartite NLS with the sequence KRPAATKKAGQAKKKK (SEQ ID NO: 54)); the c-myc NLS having the amino acid sequence PAAKRVKLD (SEQ ID NO: 55) or RQRRNELKRSP (SEQ ID NO: 57); the hRNPAI M9 NLS having the sequence NQSSNFGPMKGGNFGGRSSGPYGGGGQYFAKPRNQGGY (SEQ ID NO: 58); the sequence RMRIZFKNKGKDTAELRRRRVEVSVELRKAKKDEQILKRRNV (SEQ ID NO: 59) of the IBB domain from importin-alpha; the sequences VSRKRPRP (SEQ ID NO: 9088) and PPKKARED (SEQ ID NO: 9089) of the myoma T protein; the sequence PQPKKKPL (SEQ ID NO: 9090) of human p53; the sequence SALIKKKKKMAP (SEQ ID NO: 9091) of mouse c-abl IV; the sequences DRLRR (SEQ ID NO: 9092) and PKQKKRK (SEQ ID NO: 9093) of the influenza virus NS1; the sequence RKLKKKIKKL (SEQ ID NO: 9094) of the Hepatitis virus delta antigen; the sequence REKKKFLKRR (SEQ ID NO: 9095) of the mouse Mx1 protein; the sequence KRKGDEVDGVDEVAKKKSKK (SEQ ID NO: 9096) of the human poly (ADP-ribose) polymerase; and the sequence RKCLQAGMNLEARKTKK (SEQ ID NO: 9097) of the steroid hormone receptors (human) glucocorticoid. In general, the one or more NLSs are of sufficient strength to drive accumulation of the DNA-targeting Cas protein in a detectable amount in the nucleus of a eukaryotic cell. In general, strength of nuclear localization activity may derive from the number of NLSs in the CRISPR-Cas protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for deaminase activity) at the target sequence, or assay for altered gene expression activity affected by DNA-targeting complex formation and/or DNA-targeting), as compared to a control not exposed to the CRISPR-Cas protein and deaminase protein, or exposed to a CRISPR-Cas and/or deaminase protein lacking the one or more NLSs.

The CRISPR-Cas and/or nucleotide deaminase proteins may be provided with 1 or more, such as with, 2, 3, 4, 5, 6, 7, 8, 9, 10, or more heterologous NLSs. In some embodiments, the proteins comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. In preferred embodiments of the CRISPR-Cas proteins, an NLS attached to the C-terminal of the protein.

In certain embodiments, the CRISPR-Cas protein and the deaminase protein are delivered to the cell or expressed within the cell as separate proteins. In these embodiments, each of the CRISPR-Cas and deaminase protein can be provided with one or more NLSs as described herein. In certain embodiments, the CRISPR-Cas and deaminase proteins are delivered to the cell or expressed with the cell as a fusion protein. In these embodiments one or both of the CRISPR-Cas and deaminase protein is provided with one or more NLSs. Where the nucleotide deaminase is fused to an adaptor protein (such as MS2) as described above, the one or more NLS can be provided on the adaptor protein, provided that this does not interfere with aptamer binding. In particular embodiments, the one or more NLS sequences may also function as linker sequences between the nucleotide deaminase and the CRISPR-Cas protein.

In certain embodiments, guides of the disclosure comprise specific binding sites (e.g. aptamers) for adapter proteins, which may be linked to or fused to a nucleotide deaminase or catalytic domain thereof. When such a guide forms a CRISPR complex (e.g., CRISPR-Cas protein binding to guide and target), the adapter proteins bind and the nucleotide deaminase or catalytic domain thereof associated with the adapter protein is positioned in a spatial orientation which is advantageous for the attributed function to be effective.

The skilled person will understand that modifications to the guide which allow for binding of the adapter+nucleotide deaminase, but not proper positioning of the adapter+nucleotide deaminase (e.g. due to steric hindrance within the three-dimensional structure of the CRISPR complex) are modifications which are not intended. The one or more modified guide may be modified at the tetra loop, the stem loop 1, stem loop 2, or stem loop 3, as described herein, preferably at either the tetra loop or stem loop 2, and in some cases at both the tetra loop and stem loop 2.

In some embodiments, a component (e.g., the dead Cas protein, the nucleotide deaminase protein or catalytic domain thereof, or a combination thereof) in the systems may comprise one or more nuclear export signals (NES), one or more nuclear localization signals (NLS), or any combinations thereof. In some cases, the NES may be an HIV Rev NES. In certain cases, the NES may be MAPK NES. When the component is a protein, the NES or NLS may be at the C terminus of component. Alternatively, or additionally, the NES or NLS may be at the N terminus of component. In some examples, the Cas protein and optionally said nucleotide deaminase protein or catalytic domain thereof comprise one or more heterologous nuclear export signal(s) (NES(s)) or nuclear localization signal(s) (NLS(s)), preferably an HIV Rev NES or MAPK NES, preferably C-terminal.

Templates

In some embodiments, the composition for engineering cells comprise a template, e.g., a recombination template. A template may be a component of another vector as described herein, contained in a separate vector, or provided as a separate polynucleotide. In some embodiments, a recombination template is designed to serve as a template in homologous recombination, such as within or near a target sequence nicked or cleaved by a nucleic acid-targeting effector protein as a part of a nucleic acid-targeting complex.

In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include sequence that corresponds to a site on the target sequence that is cleaved by a Cas protein mediated cleavage event. In an embodiment, the template nucleic acid may include a sequence that corresponds to both, a first site on the target sequence that is cleaved in a first Cas protein mediated event, and a second site on the target sequence that is cleaved in a second Cas protein mediated event.

In certain embodiments, the template nucleic acid can include a sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include a sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a target gene may be used to alter the structure of a target sequence. The template sequence may be used to alter an unwanted structure, e.g., an unwanted or mutant nucleotide. The template nucleic acid may include a sequence which, when integrated, results in decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

The template nucleic acid may include a sequence which results in a change in sequence of 1, 2, 3, 4, 5, 6, 7, 8, 9, 10, 11, 12 or more nucleotides of the target sequence.

A template polynucleotide may be of any suitable length, such as about or more than about 10, 15, 20, 25, 50, 75, 100, 150, 200, 500, 1000, or more nucleotides in length. In an embodiment, the template nucleic acid may be 20+/−10, 30+/−10, 40+/−10, 50+/−10, 60+/−10, 70+/−10, 80+/−10, 90+/−10, 100+/−10, 1 10+/−10, 120+/−10, 130+/−10, 140+/−10, 150+/−10, 160+/−10, 170+/−10, 1 80+/−10, 190+/−10, 200+/−10, 210+/−10, of 220+/−10 nucleotides in length. In an embodiment, the template nucleic acid may be 30+/−20, 40+/−20, 50+/−20, 60+/−20, 70+/−20, 80+/−20, 90+/−20, 100+/−20, 1 10+/−20, 120+/−20, 130+/−20, 140+/−20, 150+/−20, 160+/−20, 170+/−20, 180+/−20, 190+/−20, 200+/−20, 210+/−20, of 220+/−20 nucleotides in length. In an embodiment, the template nucleic acid is 10 to 1,000, 20 to 900, 30 to 800, 40 to 700, 50 to 600, 50 to 500, 50 to 400, 50 to 300, 50 to 200, or 50 to 100 nucleotides in length.

In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the disclosure can be constructed using recombinant techniques (see, for example, Sambrook et al., 2001 and Ausubel et al., 1996).

In certain embodiments, a template nucleic acid for correcting a mutation may designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

Suzuki et al. describe in vivo genome editing via CRISPR/Cas9 mediated homology-independent targeted integration (2016, Nature 540:144-149), which is incorporated by reference herein and can be adapted for use with the present invention.

TALE Nucleases

In some embodiments, a TALE nuclease or TALE nuclease system can be used to modify a polynucleotide. In some embodiments, the methods provided herein use isolated, non-naturally occurring, recombinant or engineered DNA binding proteins that comprise TALE monomers or TALE monomers or half monomers as a part of their organizational structure that enable the targeting of nucleic acid sequences with improved efficiency and expanded specificity.

Naturally occurring TALEs or "wild type TALEs" are nucleic acid binding proteins secreted by numerous species of proteobacteria. TALE polypeptides contain a nucleic acid binding domain composed of tandem repeats of highly conserved monomer polypeptides that are predominantly 33, 34 or 35 amino acids in length and that differ from each other mainly in amino acid positions 12 and 13. In advantageous embodiments the nucleic acid is DNA. As used herein, the term "polypeptide monomers", "TALE monomers" or "monomers" will be used to refer to the highly conserved repetitive polypeptide sequences within the TALE nucleic acid binding domain and the term "repeat variable di-residues" or "RVD" will be used to refer to the highly variable amino acids at positions 12 and 13 of the polypeptide monomers. As provided throughout the disclosure, the amino acid residues of the RVD are depicted using the IUPAC single letter code for amino acids. A general representation of a TALE monomer which is comprised within the DNA binding domain is $X_{1-11}$-$(X_{12}X_{13})$-$X_{14-33}$ or $_{34}$ or $_{35}$, where the subscript indicates the amino acid position and X represents any amino acid. $X_{12}X_{13}$ indicate the RVDs. In some polypeptide monomers, the variable amino acid at position 13 is missing or absent and in such monomers, the RVD consists of a single amino acid. In such cases the RVD may be alternatively represented as X*, where X represents $X_{12}$ and (*) indicates that $X_{13}$ is absent. The DNA binding domain comprises several repeats of TALE monomers and this may be represented as $(X_{1-11}$-$(X_{12}X_{13})$-$X_{14-33}$ or $_{34}$ or ₃₅)ᵤ, where in an advantageous embodiment, z is at least 5 to 40. In a further advantageous embodiment, z is at least 10 to 26.

The TALE monomers can have a nucleotide binding affinity that is determined by the identity of the amino acids in its RVD. For example, polypeptide monomers with an RVD of NI can preferentially bind to adenine (A), monomers with an RVD of NG can preferentially bind to thymine (T), monomers with an RVD of HD can preferentially bind to cytosine (C) and monomers with an RVD of NN can preferentially bind to both adenine (A) and guanine (G). In some embodiments, monomers with an RVD of IG can preferentially bind to T. Thus, the number and order of the polypeptide monomer repeats in the nucleic acid binding domain of a TALE determines its nucleic acid target specificity. In some embodiments, monomers with an RVD of NS can recognize all four base pairs and can bind to A, T, G or C. The structure and function of TALEs is further described in, for example, Moscou et al., Science 326:1501 (2009); Boch et al., Science 326:1509-1512 (2009); and Zhang et al., Nature Biotechnology 29:149-153 (2011).

The polypeptides used in methods of the invention can be isolated, non-naturally occurring, recombinant or engineered nucleic acid-binding proteins that have nucleic acid or DNA binding regions containing polypeptide monomer repeats that are designed to target specific nucleic acid sequences.

As described herein, polypeptide monomers having an RVD of HN or NH preferentially bind to guanine and thereby allow the generation of TALE polypeptides with high binding specificity for guanine containing target nucleic acid sequences. In some embodiments, polypeptide monomers having RVDs RN, NN, NK, SN, NH, KN, HN, NQ, HH, RG, KH, RH and SS can preferentially bind to guanine. In some embodiments, polypeptide monomers having RVDs RN, NK, NQ, HH, KH, RH, SS and SN can preferentially bind to guanine and can thus allow the generation of TALE polypeptides with high binding specificity for guanine containing target nucleic acid sequences. In some embodiments, polypeptide monomers having RVDs HH, KH, NH, NK, NQ, RH, RN and SS can preferentially bind to guanine and thereby allow the generation of TALE polypeptides with high binding specificity for guanine containing target nucleic acid sequences. In some embodiments, the RVDs that have high binding specificity for guanine are RN, NH RH and KH. Furthermore, polypeptide monomers having an RVD of NV can preferentially bind to adenine and guanine. In some embodiments, monomers having RVDs of H*, HA, KA, N*, NA, NC, NS, RA, and S* bind to adenine, guanine, cytosine and thymine with comparable affinity.

The predetermined N-terminal to C-terminal order of the one or more polypeptide monomers of the nucleic acid or DNA binding domain determines the corresponding predetermined target nucleic acid sequence to which the polypeptides of the invention will bind. As used herein the monomers and at least one or more half monomers are "specifically ordered to target" the genomic locus or gene of interest. In plant genomes, the natural TALE-binding sites always begin with a thymine (T), which may be specified by a cryptic signal within the non-repetitive N-terminus of the TALE polypeptide; in some cases, this region may be referred to as repeat 0. In animal genomes, TALE binding sites do not necessarily have to begin with a thymine (T) and polypeptides of the invention may target DNA sequences that begin with T, A, G or C. The tandem repeat of TALE monomers always ends with a half-length repeat or a stretch of sequence that may share identity with only the first 20 amino acids of a repetitive full-length TALE monomer and this half repeat may be referred to as a half-monomer. Therefore, it follows that the length of the nucleic acid or DNA being targeted is equal to the number of full monomers plus two.

As described in Zhang et al., Nature Biotechnology 29:149-153 (2011), TALE polypeptide binding efficiency may be increased by including amino acid sequences from the "capping regions" that are directly N-terminal or C-terminal of the DNA binding region of naturally occurring TALEs into the engineered TALEs at positions N-terminal or C-terminal of the engineered TALE DNA binding region. Thus, in certain embodiments, the TALE polypeptides described herein further comprise an N-terminal capping region and/or a C-terminal capping region.

An exemplary amino acid sequence of a N-terminal capping region is:

(SEQ ID NO: 9098)
M D P I R S R T P S P A R E L L S G P Q P D G V Q

P T A D R G V S P P A G G P L D G L P A R R T M S

R T R L P S P P A P S P A F S A D S F S D L L R Q

F D P S L F N T S L F D S L P P F G A H H T E A A

T G E W D E V Q S G L R A A D A P P P T M R V A V

T A A R P P R A K P A P R R R A A Q P S D A S P A

A Q V D L R T L G Y S Q Q Q O E K I K P K V R S T

V A Q H H E A L V G H G F T H A H I V A L S Q H P

A A L G T V A V K Y Q D M I A A L P E A T H E A I

V G V G K Q W S G A R A L E A L L T V A G E L R G

P P L Q L D T G Q L L K I A K R G G V T A V E A V

H A W R N A L T G A P L N

An exemplary amino acid sequence of a C-terminal capping region is:

(SEQ ID NO: 9099)
R P A L E S I V A Q L S R P D P A L A A L T N D H

L V A L A C L G G R P A L D A V K K G L P H A P A

L I K R T N R R I P E R T S H R V A D H A Q V V R

V L G F F Q C H S H P A Q A F D D A M T Q F G M S

R H G L L Q L F R R V G V T E L E A R S G T L P P

A S Q R W D R I L Q A S G M K R A K P S P T S T Q

T P D Q A S L H A F A D S L E R D L D A P S P M H

E G D Q T R A S

As used herein the predetermined "N-terminus" to "C terminus" orientation of the N-terminal capping region, the DNA binding domain comprising the repeat TALE monomers and the C-terminal capping region provide structural basis for the organization of different domains in the d-TALEs or polypeptides of the invention.

The entire N-terminal and/or C-terminal capping regions are not necessary to enhance the binding activity of the DNA binding region. Therefore, in certain embodiments, fragments of the N-terminal and/or C-terminal capping regions are included in the TALE polypeptides described herein.

In certain embodiments, the TALE polypeptides described herein contain a N-terminal capping region fragment that included at least 10, 20, 30, 40, 50, 54, 60, 70, 80, 87, 90, 94, 100, 102, 110, 117, 120, 130, 140, 147, 150, 160, 170, 180, 190, 200, 210, 220, 230, 240, 250, 260 or 270 amino acids of an N-terminal capping region. In certain embodiments, the N-terminal capping region fragment amino acids are of the C-terminus (the DNA-binding region proximal end) of an N-terminal capping region. As described in Zhang et al., *Nature Biotechnology* 29:149-153 (2011), N-terminal capping region fragments that include the C-terminal 240 amino acids enhance binding activity equal to the full length capping region, while fragments that include the C-terminal 147 amino acids retain greater than 80% of the efficacy of the full length capping region, and fragments that include the C-terminal 117 amino acids retain greater than 50% of the activity of the full-length capping region.

In some embodiments, the TALE polypeptides described herein contain a C-terminal capping region fragment that included at least 6, 10, 20, 30, 37, 40, 50, 60, 68, 70, 80, 90, 100, 110, 120, 127, 130, 140, 150, 155, 160, 170, 180 amino acids of a C-terminal capping region. In certain embodiments, the C-terminal capping region fragment amino acids are of the N-terminus (the DNA-binding region proximal end) of a C-terminal capping region. As described in Zhang et al., Nature Biotechnology 29:149-153(2011), C-terminal capping region fragments that include the C-terminal 68 amino acids enhance binding activity equal to the full-length capping region, while fragments that include the C-terminal 20 amino acids retain greater than 50% of the efficacy of the full-length capping region.

In certain embodiments, the capping regions of the TALE polypeptides described herein do not need to have identical sequences to the capping region sequences provided herein. Thus, in some embodiments, the capping region of the TALE polypeptides described herein have sequences that are at least 50%, 60%, 70%, 80%, 85%, 90%, 91%, 92%, 93%, 94%, 95%, 96%, 97%, 98% or 99% identical or share identity to the capping region amino acid sequences provided herein. Sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences. In some preferred embodiments, the capping region of the TALE polypeptides described herein have sequences that are at least 95% identical or share identity to the capping region amino acid sequences provided herein.

Sequence homologies can be generated by any of a number of computer programs known in the art, which include but are not limited to BLAST or FASTA. Suitable computer programs for carrying out alignments like the GCG Wisconsin Bestfit package may also be used. Once the software has produced an optimal alignment, it is possible to calculate % homology, preferably % sequence identity. The software typically does this as part of the sequence comparison and generates a numerical result.

In some embodiments described herein, the TALE polypeptides of the invention include a nucleic acid binding domain linked to the one or more effector domains. The terms "effector domain" or "regulatory and functional domain" refer to a polypeptide sequence that has an activity other than binding to the nucleic acid sequence recognized by the nucleic acid binding domain. By combining a nucleic acid binding domain with one or more effector domains, the polypeptides of the invention may be used to target the one or more functions or activities mediated by the effector domain to a particular target DNA sequence to which the nucleic acid binding domain specifically binds.

In some embodiments of the TALE polypeptides described herein, the activity mediated by the effector domain is a biological activity. For example, in some embodiments the effector domain is a transcriptional inhibitor (i.e., a repressor domain), such as an mSin interaction domain (SID). SID4X domain or a Krüppel-associated box (KRAB) or fragments of the KRAB domain. In some embodiments, the effector domain is an enhancer of transcription (i.e., an activation domain), such as the VP16, VP64 or p65 activation domain. In some embodiments, the nucleic acid binding is linked, for example, with an effector domain that includes but is not limited to a transposase, integrase, recombinase, resolvase, invertase, protease, DNA methyltransferase, DNA demethylase, histone acetylase, histone deacetylase, nuclease, transcriptional repressor, transcriptional activator, transcription factor recruiting, protein nuclear-localization signal or cellular uptake signal.

In some embodiments, the effector domain is a protein domain which exhibits activities which include but are not limited to transposase activity, integrase activity, recombinase activity, resolvase activity, invertase activity, protease activity, DNA methyltransferase activity, DNA demethylase activity, histone acetylase activity, histone deacetylase activity, nuclease activity, nuclear-localization signaling activity, transcriptional repressor activity, transcriptional activator activity, transcription factor recruiting activity, or cellular uptake signaling activity. Other preferred embodiments of the invention may include any combination of the activities described herein.

Meganucleases

In some embodiments, a meganuclease or system thereof can be used to modify a polynucleotide. Meganucleases, which are endodeoxyribonucleases characterized by a large recognition site (double-stranded DNA sequences of 12 to 40 base pairs). Exemplary methods for using meganucleases can be found in U.S. Pat. Nos. 8,163,514, 8,133,697, 8,021,867, 8,119,361, 8,119,381, 8,124,369, and 8,129,134, which are specifically incorporated herein by reference.

RNAi

In certain embodiments, the genetic modifying agent is RNAi (e.g., shRNA). As used herein, "gene silencing" or "gene silenced" in reference to an activity of an RNAi molecule, for example a siRNA or miRNA refers to a decrease in the mRNA level in a cell for a target gene by at least about 5%, about 10%, about 20%, about 30%, about 40%, about 50%, about 60%, about 70%, about 80%, about 90%, about 95%, about 99%, about 100% of the mRNA level found in the cell without the presence of the miRNA or RNA interference molecule. In one preferred embodiment, the mRNA levels are decreased by at least about 70%, about 80%, about 90%, about 95%, about 99%, about 100%.

As used herein, the term "RNAi" refers to any type of interfering RNA, including but not limited to, siRNAi, shRNAi, endogenous microRNA and artificial microRNA. For instance, it includes sequences previously identified as siRNA, regardless of the mechanism of down-stream processing of the RNA (i.e. although siRNAs are believed to have a specific method of in vivo processing resulting in the cleavage of mRNA, such sequences can be incorporated into the vectors in the context of the flanking sequences described herein). The term "RNAi" can include both gene silencing RNAi molecules, and also RNAi effector molecules which activate the expression of a gene.

As used herein, a "siRNA" refers to a nucleic acid that forms a double stranded RNA, which double stranded RNA has the ability to reduce or inhibit expression of a gene or target gene when the siRNA is present or expressed in the same cell as the target gene. The double stranded RNA siRNA can be formed by the complementary strands. In one embodiment, a siRNA refers to a nucleic acid that can form a double stranded siRNA. The sequence of the siRNA can correspond to the full-length target gene, or a subsequence thereof. Typically, the siRNA is at least about 15-50 nucleotides in length (e.g., each complementary sequence of the double stranded siRNA is about 15-50 nucleotides in length, and the double stranded siRNA is about 15-50 base pairs in length, preferably about 19-30 base nucleotides, preferably about 20-25 nucleotides in length, e.g., 20, 21, 22, 23, 24, 25, 26, 27, 28, 29, or 30 nucleotides in length).

As used herein "shRNA" or "small hairpin RNA" (also called stem loop) is a type of siRNA. In one embodiment, these shRNAs are composed of a short, e.g. about 19 to about 25 nucleotide, antisense strand, followed by a nucleotide loop of about 5 to about 9 nucleotides, and the analogous sense strand. Alternatively, the sense strand can precede the nucleotide loop structure and the antisense strand can follow.

The terms "microRNA" or "miRNA" are used interchangeably herein are endogenous RNAs, some of which are known to regulate the expression of protein-coding genes at the posttranscriptional level. Endogenous microRNAs are small RNAs naturally present in the genome that are capable of modulating the productive utilization of mRNA. The term artificial microRNA includes any type of RNA sequence, other than endogenous microRNA, which is capable of modulating the productive utilization of mRNA. MicroRNA sequences have been described in publications such as Lim, et al., Genes & Development, 17, p. 991-1008 (2003), Lim et al Science 299, 1540 (2003), Lee and Ambros Science, 294, 862 (2001), Lau et al., Science 294, 858-861 (2001), Lagos-Quintana et al, Current Biology, 12, 735-739 (2002), Lagos Quintana et al, Science 294, 853-857 (2001), and Lagos-Quintana et al, RNA, 9, 175-179 (2003), which are incorporated herein by reference. Multiple microRNAs can also be incorporated into a precursor molecule. Furthermore, miRNA-like stem-loops can be expressed in cells as a vehicle to deliver artificial miRNAs and short interfering RNAs (siRNAs) for the purpose of modulating the expression of endogenous genes through the miRNA and/or RNAi pathways.

As used herein, "double stranded RNA" or "dsRNA" refers to RNA molecules that are comprised of two strands. Double-stranded molecules include those comprised of a single RNA molecule that doubles back on itself to form a two-stranded structure. For example, the stem loop structure of the progenitor molecules from which the single-stranded miRNA is derived, called the pre-miRNA (Bartel et al. 2004. Cell 1 16:281-297), comprises a dsRNA molecule.

Engineered Cells and Organisms

Described herein are engineered cells that can include one or more of the engineered muscle-specific targeting moiety polynucleotides, polypeptides, vectors, and/or vector systems. In some embodiments, one or more of the engineered muscle-specific targeting moiety polynucleotides can be expressed in the engineered cells. In some embodiments, the engineered cells can be capable of producing engineered muscle-specific viral capsid proteins and/or engineered muscle-specific viral particles that are described elsewhere herein. Also described herein are modified or engineered organisms that can include one or more engineered cells described herein. The engineered cells can be engineered to express a cargo molecule (e.g. a cargo polynucleotide) dependently or independently of an engineered muscle-specific viral capsid polynucleotide as described elsewhere herein.

A wide variety of animals, plants, algae, fungi, yeast, etc. and animal, plant, algae, fungus, yeast cell or tissue systems may be engineered to express one or more nucleic acid constructs of the engineered muscle-specific delivery system described herein using various transformation methods mentioned elsewhere herein. This can produce organisms that can produce engineered muscle-specific targeting moiety or composition thereof, such as for production purposes, engineered muscle-specific viral capsid design and/or generation, and/or model organisms. In some embodiments, the polynucleotide(s) encoding one or more components of the engineered viral capsid system described herein can be stably or transiently incorporated into one or more cells of a plant, animal, algae, fungus, and/or yeast or tissue system. In some embodiments, one or more of engineered viral capsid system polynucleotides are genomically incorporated into one or more cells of a plant, animal, algae, fungus, and/or yeast or tissue system. Further embodiments of the modified organisms and systems are described elsewhere herein. In some embodiments, one or more components of the engineered viral capsid system described herein are expressed in one or more cells of the plant, animal, algae, fungus, yeast, or tissue systems.

Engineered Cells

Described herein are various embodiments of engineered cells that can include one or more of the engineered muscle-specific targeting moiety, composition thereof, and/or delivery system thereof polynucleotides, polypeptides, vectors, and/or vector systems described elsewhere herein. In some embodiments, the cells can express one or more of the engineered muscle-specific targeting moiety polynucleotides and can produce one or more engineered muscle-specific viral particles, which are described in greater detail herein. Such cells are also referred to herein as "producer cells". It will be appreciated that these engineered cells are different from "modified cells" described elsewhere herein in that the modified cells are not necessarily producer cells (i.e. they do not make engineered muscle-specific delivery particles (i.e. particles that can deliver a cargo to a cell in a muscle-specific manner guided by a muscle-specific targeting moiety described herein) unless they include one or more of the engineered viral capsid polynucleotides, engineered viral capsid vectors or other vectors described herein that render the cells capable of producing an engineered virus particle or are modified to produce compositions (such as proteins) that include one or more engineered muscle-specific targeting moieties.

Modified cells can be recipient cells of a cargo delivered by a delivery vehicle (e.g. viral, vector, or non-vector delivery vehicle) that includes one or more engineered muscle-specific targeting moieties, and can, in some embodiments, be modified by the delivery vehicle and/or a cargo polynucleotide delivered to the recipient cell. Modified cells are discussed in greater detail elsewhere herein. The term modification can be used in connection with modification of a cell that is not dependent on being a recipient cell. For example, isolated cells can be modified prior to receiving an engineered delivery vehicle described herein.

In an embodiment, the invention provides a non-human eukaryotic organism; for example, a multicellular eukaryotic organism, including a eukaryotic host cell containing one or more components of an engineered muscle-specific delivery system described herein according to any of the described embodiments. In other embodiments, the invention provides a eukaryotic organism; preferably a multicellular eukaryotic organism, comprising a eukaryotic host cell containing one or more components of an engineered delivery system described herein according to any of the described embodiments. In some embodiments, the organism is a host of AAV.

In particular embodiments, the plants, algae, fungi, yeast, etc., cells or parts obtained are transgenic plants, comprising an exogenous DNA sequence incorporated into the genome of all or part of the cells.

The engineered cell can be a prokaryotic cell. The prokaryotic cell can be bacterial cell. The prokaryotic cell can be an archaea cell. The bacterial cell can be any suitable bacterial cell. Suitable bacterial cells can be from the genus *Escherichia, Bacillus, Lactobacillus, Rhodococcus, Rhodobacter, Synechococcus, Synechocystis, Pseudomonas, Pseudoalteromonas, Stenotrophomonas*, and *Streptomyces* Suitable bacterial cells include, but are not limited to *Escherichia coli* cells, *Caulobacter crescentus* cells, *Rhodobacter sphaeroides* cells, *Psedoaltermonas haloplanktis* cells. Suitable strains of bacterial include, but are not limited to BL21(DE3), DL21(DE3)-pLysS, BL21 Star-pLysS, BL21-SI, BL21-AI, Tuner, Tuner pLysS, Origami, Origami B pLysS, Rosetta, Rosetta pLysS, Rosetta-gami-pLysS, BL21 CodonPlus, AD494, BL2trxB, HMS174, NovaBlue (DE3), BLR, C41(DE3), C43(DE3), Lemo21(DE3), Shuffle T7, ArcticExpress and Artic Express (DE3).

The engineered cell can be a eukaryotic cell. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments the engineered cell can be a cell line. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, CIR, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, $X_{63}$, YAC-1, YAR, and transgenic varieties thereof. Cell lines are available from a variety of sources known to those with skill in the art (see, e.g., the American Type Culture Collection (ATCC) (Manassas, Va.)).

In some embodiments, the engineered or modified cell is a muscle cell (e.g. cardiac muscle, skeletal muscle, and/or smooth muscle), bone cell, blood cell, immune cell (including but not limited to B cells, macrophages, T-cells, CAR-T cells, and the like), kidney cells, bladder cells, lung cells, heart cells, liver cells, brain cells, neurons, skin cells, stomach cells, neuronal support cells, intestinal cells, epithelial cells, endothelial cells, stem or other progenitor cells, adrenal gland cells, cartilage cells, and combinations thereof.

In some embodiments, the engineered cell can be a fungus cell. As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerevisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and Issatchenkia spp. (e.g., *Issatchenkia orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains can include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the S. cerevisiae strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the S. cerevisiae strain S228C may be maintained in a haploid or diploid state. A haploid cell may refer to a cell whose entire genome is haploid, or it may refer to a cell that is haploid in a particular genomic locus of interest.

In some embodiments, the engineered cell is a cell obtained from a subject. In some embodiments, the subject is a healthy or non-diseased subject. In some embodiments, the subject is a subject with a desired physiological and/or biological characteristic such that when a engineered AAV capsid particle is produced it can package one or more cargo polynucleotides that can be related to the desired physiological and/or biological characteristic and/or capable of modifying the desired physiological and/or biological characteristic. Thus, the cargo polynucleotides of the produced engineered AAV capsid particle can be capable of transferring the desired characteristic to a recipient cell. In some embodiments, the cargo polynucleotides are capable of modifying a polynucleotide of the engineered cell such that the engineered cell has a desired physiological and/or biological characteristic.

In some embodiments, a cell transfected with one or more vectors described herein is used to establish a new cell line comprising one or more vector-derived sequences.

The engineered cells can be used to produce engineered AAV capsid polynucleotides, vectors, and/or particles. In some embodiments, the engineered AAV capsid polynucleotides, vectors, and/or particles are produced, harvested, and/or delivered to a subject in need thereof. In some embodiments, the engineered cells are delivered to a subject. Other uses for the engineered cells are described elsewhere herein. In some embodiments, the engineered cells can be included in formulations and/or kits described elsewhere herein.

The engineered cells can be stored short-term or long-term for use at a later time. Suitable storage methods are generally known in the art. Further, methods of restoring the stored cells for use (such as thawing, reconstitution, and otherwise stimulating metabolism in the engineered cell after storage) at a later time are also generally known in the art.

Formulations

The compositions, polynucleotides, polypeptides, particles, cells, vector systems and combinations thereof described herein can be contained in a formulation, such as a pharmaceutical formulation. In some embodiments, the formulations can be used to generate polypeptides and other particles that include one or more muscle-specific targeting moieties described herein. In some embodiments, the formulations can be delivered to a subject in need thereof. In some embodiments, the engineered muscle-specific targeting moieties, compositions thereof, delivery systems thereof, engineered cells, engineered viral particles, and/or combinations thereof described herein can be included in a formulation that can be delivered to a subject or a cell. In some embodiments, the formulation is a pharmaceutical formulation. One or more of the polypeptides, polynucleotides, vectors, cells, and combinations thereof described herein can be provided to a subject in need thereof or a cell alone or as an active ingredient, such as in a pharmaceutical formulation. As such, also described herein are pharmaceutical formulations containing an amount of one or more of the polypeptides, polynucleotides, vectors, cells, or combinations thereof described herein. In some embodiments, the pharmaceutical formulation can contain an effective amount of the one or more of the polypeptides, polynucleotides, vectors, cells, and combinations thereof described herein. The pharmaceutical formulations described herein can be administered to a subject in need thereof or a cell.

In some embodiments, the amount of the one or more of the polypeptides, polynucleotides, vectors, cells, virus particles, nanoparticles, other delivery particles, and combinations thereof described herein contained in the pharmaceutical formulation can range from about 1 pg/kg to about 10 mg/kg based upon the bodyweight of the subject in need thereof or average bodyweight of the specific patient population to which the pharmaceutical formulation can be administered. The amount of the one or more of the polypeptides, polynucleotides, vectors, cells, and combinations thereof described herein in the pharmaceutical formulation can range from about 1 µg to about 10 g or from about 10 nL to about 10 ml. In embodiments where the pharmaceutical formulation contains one or more cells, the amount can range from about 1 cell to $1\times10^2$, $1\times10^3$, $1\times10^4$, $1\times10^5$, $1\times10^6$, $1\times10^7$, $1\times10^8$, $1\times10^9$, $1\times10^{10}$ or more cells. In embodiments where the pharmaceutical formulation contains one or more cells, the amount can range from about 1 cell to $1\times10^2$, $1\times10^3$, $1\times10^4$, $1\times10^5$, $1\times10^6$, $1\times10^7$, $1\times10^8$, $1\times10^9$, $1\times10^{10}$ or more cells per nL, µL, mL, or L.

In embodiments, were engineered AAV capsid particles are included in the formulation, the formulation can contain 1 to $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, $1\times10^{16}$, $1\times10^{17}$, $1\times10^{18}$, $1\times10^{19}$, or $1\times10^{20}$ transducing units (TU)/mL of the engineered AAV capsid particles. In some embodiments, the formulation can be 0.1 to 100 mL in volume and can contain 1 to $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, $1\times10^{16}$, $1\times10^{17}$, $1\times10^{18}$, $1\times10^{19}$, or $1\times10^{20}$ transducing units (TU)/mL of the engineered viral particles.

Pharmaceutically Acceptable Carriers and Auxiliary Ingredients and Agents

In embodiments, the pharmaceutical formulation containing an amount of one or more of the polypeptides, polynucleotides, vectors, cells, virus particles, nanoparticles, other delivery particles, and combinations thereof described herein can further include a pharmaceutically acceptable carrier. Suitable pharmaceutically acceptable carriers include, but are not limited to, water, salt solutions, alcohols, gum arabic, vegetable oils, benzyl alcohols, polyethylene glycols, gelatin, carbohydrates such as lactose, amylose or starch, magnesium stearate, talc, silicic acid, viscous paraffin, perfume oil, fatty acid esters, hydroxy methylcellulose, and polyvinyl pyrrolidone, which do not deleteriously react with the active composition.

The pharmaceutical formulations can be sterilized, and if desired, mixed with auxiliary agents, such as lubricants, preservatives, stabilizers, wetting agents, emulsifiers, salts for influencing osmotic pressure, buffers, coloring, flavoring and/or aromatic substances, and the like which do not deleteriously react with the active composition.

In addition to an amount of one or more of the polypeptides, polynucleotides, vectors, cells, viral particles, nanoparticles, other delivery particles, and combinations thereof described herein, the pharmaceutical formulation can also include an effective amount of an auxiliary active agent, including but not limited to, polynucleotides, amino acids, peptides, polypeptides, antibodies, aptamers, ribozymes, hormones, immunomodulators, antipyretics, anxiolytics, antipsychotics, analgesics, antispasmodics, anti-inflammatories, anti-histamines, anti-infectives, chemotherapeutics, and combinations thereof.

Suitable hormones include, but are not limited to, amino-acid derived hormones (e.g. melatonin and thyroxine), small peptide hormones and protein hormones (e.g. thyrotropin-releasing hormone, vasopressin, insulin, growth hormone, luteinizing hormone, follicle-stimulating hormone, and thyroid-stimulating hormone), eicosanoids (e.g. arachidonic acid, lipoxins, and prostaglandins), and steroid hormones (e.g. estradiol, testosterone, tetrahydro testosterone Cortisol). Suitable immunomodulators include, but are not limited to, prednisone, azathioprine, 6-MP, cyclosporine, tacrolimus, methotrexate, interleukins (e.g. IL-2, IL-7, and IL-12), cytokines (e.g. interferons (e.g. IFN-α, IFN-β, IFN-ε, IFN-K, IFN-ω, and IFN-γ), granulocyte colony-stimulating factor, and imiquimod), chemokines (e.g. CCL3, CCL26 and CXCL7), cytosine phosphate-guanosine, oligodeoxynucleotides, glucans, antibodies, and aptamers).

Suitable antipyretics include, but are not limited to, non-steroidal anti-inflammants (e.g. ibuprofen, naproxen, ketoprofen, and nimesulide), aspirin and related salicylates (e.g. choline salicylate, magnesium salicylate, and sodium salicylate), paracetamol/acetaminophen, metamizole, nabumetone, phenazone, and quinine.

Suitable anxiolytics include, but are not limited to, benzodiazepines (e.g. alprazolam, bromazepam, chlordiazepoxide, clonazepam, clorazepate, diazepam, flurazepam, lorazepam, oxazepam, temazepam, triazolam, and tofisopam), serotonergic antidepressants (e.g. selective serotonin reuptake inhibitors, tricyclic antidepressants, and monoamine oxidase inhibitors), mebicar, afobazole, selank, bromantane, emoxypine, azapirones, barbiturates, hydroxyzine, pregabalin, validol, and beta blockers.

Suitable antipsychotics include, but are not limited to, benperidol, bromperidol, droperidol, haloperidol, moperone, pipaperone, timiperone, fluspirilene, penfluridol, pimozide, acepromazine, chlorpromazine, cyamemazine, dixyrazine, fluphenazine, levomepromazine, mesoridazine, perazine, pericyazine, perphenazine, pipotiazine, prochlorperazine, promazine, promethazine, prothipendyl, thioproperazine, thioridazine, trifluoperazine, triflupromazine, chlorprothixene, clopenthixol, flupentixol, tiotixene, zuclopenthixol, clotiapine, loxapine, prothipendyl, carpipramine, clocapramine, molindone, mosapramine, sulpiride, veralipride, amisulpride, amoxapine, aripiprazole, asenapine, clozapine, blonanserin, iloperidone, lurasidone, melperone, nemonapride, olanzapine, paliperidone, perospirone, quetiapine, remoxipride, risperidone, sertindole, trimipramine, ziprasidone, zotepine, alstonie, bifeprunox, bitopertin, brexpiprazole, cannabidiol, cariprazine, pimavanserin, pomaglumetad methionil, vabicaserin, xanomeline, and zicronapine.

Suitable analgesics include, but are not limited to, paracetamol/acetaminophen, nonsteroidal anti-inflammants (e.g. ibuprofen, naproxen, ketoprofen, and nimesulide), COX-2 inhibitors (e.g. rofecoxib, celecoxib, and etoricoxib), opioids (e.g. morphine, codeine, oxycodone, hydrocodone, dihydromorphine, pethidine, buprenorphine), tramadol, norepinephrine, flupirtine, nefopam, orphenadrine, pregabalin, gabapentin, cyclobenzaprine, scopolamine, methadone, ketobemidone, piritramide, and aspirin and related salicylates (e.g. choline salicylate, magnesium salicylate, and sodium salicylate).

Suitable antispasmodics include, but are not limited to, mebeverine, papaverine, cyclobenzaprine, carisoprodol, orphenadrine, tizanidine, metaxalone, methocarbamol, chlorzoxazone, baclofen, dantrolene, baclofen, tizanidine, and dantrolene. Suitable anti-inflammatories include, but are not limited to, prednisone, non-steroidal anti-inflammants (e.g. ibuprofen, naproxen, ketoprofen, and nimesulide), COX-2 inhibitors (e.g. rofecoxib, celecoxib, and etoricoxib), and immune selective anti-inflammatory derivatives (e.g. submandibular gland peptide-T and its derivatives).

Suitable anti-histamines include, but are not limited to, H1-receptor antagonists (e.g. acrivastine, azelastine, bilastine, brompheniramine, buclizine, bromodiphenhydramine, carbinoxamine, cetirizine, chlorpromazine, cyclizine, chlorpheniramine, clemastine, cyproheptadine, desloratadine, dexbrompheniramine, dexchlorpheniramine, dimenhydrinate, dimetindene, diphenhydramine, doxylamine, ebastine, embramine, fexofenadine, hydroxyzine, levocetirizine, loratadine, meclozine, mirtazapine, olopatadine, orphenadrine, phenindamine, pheniramine, phenyltoloxamine, promethazine, pyrilamine, quetiapine, rupatadine, tripelennamine, and triprolidine), H2-receptor antagonists (e.g. cimetidine, famotidine, lafutidine, nizatidine, ranitidine, and roxatidine), tritoqualine, catechin, cromoglicate, nedocromil, and p2-adrenergic agonists.

Suitable anti-infectives include, but are not limited to, amebicides (e.g. nitazoxanide, paromomycin, metronidazole, tinidazole, chloroquine, miltefosine, amphotericin b, and iodoquinol), aminoglycosides (e.g. paromomycin, tobramycin, gentamicin, amikacin, kanamycin, and neomycin), anthelmintics (e.g. pyrantel, mebendazole, ivermectin, praziquantel, albendazole, thiabendazole, oxamniquine), antifungals (e.g. azole antifungals (e.g. itraconazole, fluconazole, parconazole, ketoconazole, clotrimazole, miconazole, and voriconazole), echinocandins (e.g. caspofungin, anidulafungin, and micafungin), griseofulvin, terbinafine, flucytosine, and polyenes (e.g. nystatin, and amphotericin b), antimalarial agents (e.g. pyrimethamine/sulfadoxine, artemether/lumefantrine, atovaquone/proguanil, quinine, hydroxychloroquine, mefloquine, chloroquine, doxycycline, pyrimethamine, and halofantrine), antituberculosis agents (e.g. aminosalicylates (e.g. aminosalicylic acid), isoniazid/rifampin, isoniazid/pyrazinamide/rifampin, bedaquiline, isoniazid, ethambutol, rifampin, rifabutin, rifapentine, capreomycin, and cycloserine), antivirals (e.g. amantadine, rimantadine, abacavir/lamivudine, emtricitabine/tenofovir, cobicistat/elvitegravir/emtricitabine/tenofovir, efavirenz/emtricitabine/tenofovir, abacavir/lamivudine/zidovudine, lamivudine/zidovudine, emtricitabine/tenofovir, emtricitabine/lopinavir/ritonavir/tenofovir, interferon alfa-2v/ribavirin, peginterferon alfa-2b, maraviroc, raltegravir, dolutegravir, enfuvirtide, foscarnet, fomivirsen, oseltamivir, zanamivir, nevirapine, efavirenz, etravirine, rilpivirine, delavirdine, nevirapine, entecavir, lamivudine, adefovir, sofosbuvir, didanosine, tenofovir, abacavir, zidovudine, stavudine, emtricitabine, zalcitabine, telbivudine, simeprevir, boceprevir, telaprevir, lopinavir/ritonavir, boceprevir, darunavir, ritonavir, tipranavir, atazanavir, nelfinavir, amprenavir, indinavir, saquinavir, ribavirin, valacyclovir, acyclovir, famciclovir, ganciclovir, and valganciclovir), carbapenems (e.g. doripenem, meropenem, ertapenem, and cilastatin/imipenem), cephalosporins (e.g. cefadroxil, cephradine, cefazolin, cephalexin, cefepime, cefazoline, loracarbef, cefotetan, cefuroxime, cefprozil, loracarbef, cefoxitin, cefaclor, ceftibuten, ceftriaxone, cefotaxime, cefpodoxime, cefdinir, cefixime, cefditoren, ceftizoxime, and ceftazidime), glycopeptide antibiotics (e.g. vancomycin, dalbavancin, oritavancin, and telavancin), glycylcyclines (e.g. tigecycline), leprostatics (e.g. clofazimine and thalidomide), lincomycin and derivatives thereof (e.g. clindamycin and lincomycin), macrolides and derivatives thereof (e.g. telithromycin, fidaxomicin, erythromycin, azithromycin, clarithromycin, dirithromycin, and troleandomycin), linezolid, sulfamethoxazole/trimethoprim, rifaximin, chloramphenicol, Fosfomycin, metronidazole, aztreonam, bacitracin, penicillin (amoxicillin, ampicillin, piperacillin, bacampicillin, carbenicillin, ticarcillin, amoxicillin/clavulanate, ampicillin/sulbactam, piperacillin/tazobactam, clavulanate/ticarcillin, penicillin, procaine penicillin, oxacillin, dicloxacillin, and nafcillin), quinolones (e.g. lomefloxacin, norfloxacin, ofloxacin, gatifloxacin, moxifloxacin, ciprofloxacin, levofloxacin, gemifloxacin, moxifloxacin, cinoxacin, nalidixic acid, enoxacin, grepafloxacin, gatifloxacin, trovafloxacin, and sparfloxacin), sulfonamides (e.g. sulfamethoxazole/trimethoprim, sulfasalazine, and sulfisoxazole), tetracyclines (e.g. doxycycline, demeclocycline, minocycline, doxycycline/salicylic acid, doxycycline/omega-3 polyunsaturated fatty acids, and tetracycline), and urinary anti-infectives (e.g. nitrofurantoin, methenamine, Fosfomycin, cinoxacin, nalidixic acid, trimethoprim, and methylene blue).

Suitable chemotherapeutics include, but are not limited to, paclitaxel, brentuximab vedotin, doxorubicin, 5-FU (fluorouracil), everolimus, pemetrexed, melphalan, pamidronate, anastrozole, exemestane, nelarabine, ofatumumab, bevacizumab, belinostat, tositumomab, carmustine, bleomycin, bosutinib, busulfan, alemtuzumab, irinotecan, vandetanib, bicalutamide, lomustine, daunorubicin, clofarabine, cabozantinib, dactinomycin, ramucirumab, cytarabine, Cytoxan, cyclophosphamide, decitabine, dexamethasone, docetaxel, hydroxyurea, dacarbazine, leuprolide, epirubicin, oxaliplatin, asparaginase, estramustine, cetuximab, vismodegib, asparginase *Erwinia chrysanthemi*, amifostine, etoposide, flutamide, toremifene, fulvestrant, letrozole, degarelix, pralatrexate, methotrexate, floxuridine, obinutuzumab, gemcitabine, afatinib, imatinib mesylate, carmustine, eribulin, trastuzumab, altretamine, topotecan, ponatinib, idarubicin, ifosfamide, ibrutinib, axitinib, interferon alfa-2a, gefitinib, romidepsin, ixabepilone, ruxolitinib, cabazitaxel, ado-trastuzumab emtansine, carfilzomib, chlorambucil, sargramostim, cladribine, mitotane, vincristine, procarbazine, megestrol, trametinib, mesna, strontium-89 chloride, mechlorethamine, mitomycin, busulfan, gemtuzumab ozogamicin, vinorelbine, filgrastim, pegfilgrastim, sorafenib, nilutamide, pentostatin, tamoxifen, mitoxantrone, pegaspargase, denileukin diftitox, alitretinoin, carboplatin, pertuzumab, cisplatin, pomalidomide, prednisone, aldesleukin, mercaptopurine, zoledronic acid, lenalidomide, rituximab, octreotide, dasatinib, regorafenib, histrelin, sunitinib, siltuximab, omacetaxine, thioguanine (tioguanine), dabrafenib, erlotinib, bexarotene, temozolomide, thiotepa, thalidomide, BCG, temsirolimus, bendamustine hydrochloride, triptorelin, arsenic trioxide, lapatinib, valrubicin, panitumumab, vinblastine, bortezomib, tretinoin, azacitidine, pazopanib, teniposide, leucovorin, crizotinib, capecitabine, enzalutamide, ipilimumab, goserelin, vorinostat, idelalisib, ceritinib, abiraterone, epothilone, tafluposide, azathioprine, doxifluridine, vindesine, and all-trans retinoic acid.

In embodiments where there is an auxiliary active agent contained in the pharmaceutical formulation in addition to the one or more of the polypeptides, polynucleotides, vectors, cells, virus particles, nanoparticles, other delivery particles, and combinations thereof described herein, amount, such as an effective amount, of the auxiliary active agent will vary depending on the auxiliary active agent. In some embodiments, the amount of the auxiliary active agent ranges from 0.001 micrograms to about 1 milligram. In other embodiments, the amount of the auxiliary active agent ranges from about 0.01 IU to about 1000 IU. In further embodiments, the amount of the auxiliary active agent ranges from 0.001 mL to about 1 mL. In yet other embodiments, the amount of the auxiliary active agent ranges from about 1% w/w to about 50% w/w of the total pharmaceutical formulation. In additional embodiments, the amount of the auxiliary active agent ranges from about 1% v/v to about 50% v/v of the total pharmaceutical formulation. In still other embodiments, the amount of the auxiliary active agent ranges from about 1% w/v to about 50% w/v of the total pharmaceutical formulation.

Dosage Forms

In some embodiments, the pharmaceutical formulations described herein may be in a dosage form. The dosage forms can be adapted for administration by any appropriate route. Appropriate routes include, but are not limited to, oral (including buccal or sublingual), rectal, epidural, intracranial, intraocular, inhaled, intranasal, topical (including buccal, sublingual, or transdermal), vaginal, intraurethral, parenteral, intracranial, subcutaneous, intramuscular, intravenous, intraperitoneal, intradermal, intraosseous, intracardiac, intraarticular, intracavernous, intrathecal, intravitreal, intracerebral, gingival, subgingival, intracerebroventricular, and intradermal. Such formulations may be prepared by any method known in the art.

Dosage forms adapted for oral administration can be discrete dosage units such as capsules, pellets or tablets, powders or granules, solutions, or suspensions in aqueous or non-aqueous liquids; edible foams or whips, or in oil-in-water liquid emulsions or water-in-oil liquid emulsions. In some embodiments, the pharmaceutical formulations adapted for oral administration also include one or more agents which flavor, preserve, color, or help disperse the pharmaceutical formulation. Dosage forms prepared for oral administration can also be in the form of a liquid solution that can be delivered as foam, spray, or liquid solution. In some embodiments, the oral dosage form can contain about 1 ng to 1000 g of a pharmaceutical formulation containing a therapeutically effective amount or an appropriate fraction thereof of the targeted effector fusion protein and/or complex thereof or composition containing the one or more of the polypeptides, polynucleotides, vectors, cells, and combinations thereof described herein. The oral dosage form can be administered to a subject in need thereof.

Where appropriate, the dosage forms described herein can be microencapsulated.

The dosage form can also be prepared to prolong or sustain the release of any ingredient. In some embodiments, the one or more of the polypeptides, polynucleotides, vectors, cells, and combinations thereof described herein can be the ingredient whose release is delayed. In other embodiments, the release of an optionally included auxiliary ingredient is delayed. Suitable methods for delaying the release of an ingredient include, but are not limited to, coating or embedding the ingredients in material in polymers, wax, gels, and the like. Delayed release dosage formulations can be prepared as described in standard references such as "Pharmaceutical dosage form tablets," eds. Liberman et. al. (New York, Marcel Dekker, Inc., 1989), "Remington—The science and practice of pharmacy", 20th ed., Lippincott Williams & Wilkins, Baltimore, MD, 2000, and "Pharmaceutical dosage forms and drug delivery systems", 6th Edition, Ansel et al., (Media, PA: Williams and Wilkins, 1995). These references provide information on excipients, materials, equipment, and processes for preparing tablets and capsules and delayed release dosage forms of tablets and pellets, capsules, and granules. The delayed release can be anywhere from about an hour to about 3 months or more.

Examples of suitable coating materials include, but are not limited to, cellulose polymers such as cellulose acetate phthalate, hydroxypropyl cellulose, hydroxypropyl methylcellulose, hydroxypropyl methylcellulose phthalate, and hydroxypropyl methylcellulose acetate succinate; polyvinyl acetate phthalate, acrylic acid polymers and copolymers, and methacrylic resins that are commercially available under the trade name EUDRAGIT® (Roth Pharma, Weiterstadt, Germany), zein, shellac, and polysaccharides.

Coatings may be formed with a different ratio of water-soluble polymer, water insoluble polymers, and/or pH dependent polymers, with or without water insoluble/water soluble non-polymeric excipient, to produce the desired release profile. The coating is either performed on the dosage form (matrix or simple) which includes, but is not limited to, tablets (compressed with or without coated beads), capsules (with or without coated beads), beads, particle compositions, "ingredient as is" formulated as, but not limited to, suspension form or as a sprinkle dosage form.

Dosage forms adapted for topical administration can be formulated as ointments, creams, suspensions, lotions, powders, solutions, pastes, gels, sprays, aerosols, or oils. In some embodiments for treatments of the eye or other external tissues, for example the mouth or the skin, the pharmaceutical formulations are applied as a topical ointment or cream. When formulated in an ointment, the one or more of the polypeptides, polynucleotides, vectors, cells, and combinations thereof described herein can be formulated with a paraffinic or water-miscible ointment base. In some embodiments, the active ingredient can be formulated in a cream with an oil-in-water cream base or a water-in-oil base. Dosage forms adapted for topical administration in the mouth include lozenges, pastilles, and mouth washes.

Dosage forms adapted for nasal or inhalation administration include aerosols, solutions, suspension drops, gels, or dry powders. In some embodiments, the one or more of the polypeptides, polynucleotides, vectors, cells, and combinations thereof described herein is contained in a dosage form adapted for inhalation is in a particle-size-reduced form that is obtained or obtainable by micronization. In some embodiments, the particle size of the size reduced (e.g. micronized) compound or salt or solvate thereof, is defined by a D50 value of about 0.5 to about 10 microns as measured by an appropriate method known in the art. Dosage forms adapted for administration by inhalation also include particle dusts or mists. Suitable dosage forms wherein the carrier or excipient is a liquid for administration as a nasal spray or drops include aqueous or oil solutions/suspensions of an active ingredient (e.g. the one or more of the polypeptides, polynucleotides, vectors, cells, and combinations thereof described herein and/or auxiliary active agent), which may be generated by various types of metered dose pressurized aerosols, nebulizers, or insufflators.

In some embodiments, the dosage forms can be aerosol formulations suitable for administration by inhalation. In some of these embodiments, the aerosol formulation can contain a solution or fine suspension of the one or more of the polypeptides, polynucleotides, vectors, cells, and combinations thereof described herein and a pharmaceutically acceptable aqueous or non-aqueous solvent. Aerosol formulations can be presented in single or multi-dose quantities in sterile form in a sealed container. For some of these embodiments, the sealed container is a single dose or multi-dose nasal or an aerosol dispenser fitted with a metering valve (e.g. metered dose inhaler), which is intended for disposal once the contents of the container have been exhausted.

Where the aerosol dosage form is contained in an aerosol dispenser, the dispenser contains a suitable propellant under pressure, such as compressed air, carbon dioxide, or an organic propellant, including but not limited to a hydrofluorocarbon. The aerosol formulation dosage forms in other embodiments are contained in a pump-atomizer. The pressurized aerosol formulation can also contain a solution or a suspension of one or more of the polypeptides, polynucleotides, vectors, cells, and combinations thereof described herein. In further embodiments, the aerosol formulation can also contain co-solvents and/or modifiers incorporated to improve, for example, the stability and/or taste and/or fine particle mass characteristics (amount and/or profile) of the formulation. Administration of the aerosol formulation can be once daily or several times daily, for example 2, 3, 4, or 8 times daily, in which 1, 2, or 3 doses are delivered each time.

For some dosage forms suitable and/or adapted for inhaled administration, the pharmaceutical formulation is a dry powder inhalable formulation. In addition to the one or more of the polypeptides, polynucleotides, vectors, cells, and combinations thereof described herein, an auxiliary active ingredient, and/or pharmaceutically acceptable salt thereof, such a dosage form can contain a powder base such as lactose, glucose, trehalose, mannitol, and/or starch. In some of these embodiments, the one or more of the polypeptides, polynucleotides, vectors, cells, and combinations thereof described herein is in a particle-size reduced form. In further embodiments, a performance modifier, such as L-leucine or another amino acid, cellobiose octaacetate, and/or metals salts of stearic acid, such as magnesium or calcium stearate.

In some embodiments, the aerosol dosage forms can be arranged so that each metered dose of aerosol contains a predetermined amount of an active ingredient, such as the one or more of the one or more of the polypeptides, polynucleotides, vectors, cells, and combinations thereof described herein.

Dosage forms adapted for vaginal administration can be presented as pessaries, tampons, creams, gels, pastes, foams, or spray formulations. Dosage forms adapted for rectal administration include suppositories or enemas.

Dosage forms adapted for parenteral administration and/or adapted for any type of injection (e.g. intravenous, intraperitoneal, subcutaneous, intramuscular, intradermal, intraosseous, epidural, intracardiac, intraarticular, intracavernous, gingival, subgingival, intrathecal, intravitreal, intracerebral, and intracerebroventricular) can include aqueous and/or non-aqueous sterile injection solutions, which can contain anti-oxidants, buffers, bacteriostatic, solutes that render the composition isotonic with the blood of the subject, and aqueous and non-aqueous sterile suspensions, which can include suspending agents and thickening agents. The dosage forms adapted for parenteral administration can be presented in a single-unit dose or multi-unit dose containers, including but not limited to sealed ampoules or vials. The doses can be lyophilized and resuspended in a sterile carrier to reconstitute the dose prior to administration. Extemporaneous injection solutions and suspensions can be prepared in some embodiments, from sterile powders, granules, and tablets.

Dosage forms adapted for ocular administration can include aqueous and/or nonaqueous sterile solutions that can optionally be adapted for injection, and which can optionally contain anti-oxidants, buffers, bacteriostats, solutes that render the composition isotonic with the eye or fluid contained therein or around the eye of the subject, and aqueous and nonaqueous sterile suspensions, which can include suspending agents and thickening agents.

For some embodiments, the dosage form contains a predetermined amount of the one or more of the polypeptides, polynucleotides, vectors, cells, and combinations thereof described herein per unit dose. In some embodiments, the predetermined amount of the such unit doses may therefore be administered once or more than once a day. Such pharmaceutical formulations may be prepared by any of the methods well known in the art.

Kits

Also described herein are kits that contain one or more of the one or more of the compositions, polypeptides, polynucleotides, vectors, cells, viral particles, other delivery vehicles, or other components described herein and combinations thereof and pharmaceutical formulations described herein. In embodiments, one or more of the polypeptides, polynucleotides, vectors, cells, and combinations thereof described herein can be presented as a combination kit. As used herein, the terms "combination kit" or "kit of parts" refers to the compounds, or formulations and additional components that are used to package, screen, test, sell, market, deliver, and/or administer the combination of elements or a single element, such as the active ingredient, contained therein. Such additional components include but are not limited to, packaging, syringes, blister packages, bottles, and the like. The combination kit can contain one or more of the components (e.g. one or more of the one or more of the polypeptides, polynucleotides, vectors, cells, and combinations thereof) or formulation thereof can be provided in a single formulation (e.g. a liquid, lyophilized powder, etc.), or in separate formulations. The separate components or formulations can be contained in a single package or in separate packages within the kit. The kit can also include instructions in a tangible medium of expression that can contain information and/or directions regarding the content of the components and/or formulations contained therein, safety information regarding the content of the components(s) and/or formulation(s) contained therein, information regarding the amounts, dosages, indications for use, screening methods, component design recommendations and/or information, recommended treatment regimen(s) for the components(s) and/or formulations contained therein. As used herein, "tangible medium of expression" refers to a medium that is physically tangible or accessible and is not a mere abstract thought or an unrecorded spoken word. "Tangible medium of expression" includes, but is not limited to, words on a cellulosic or plastic material, or data stored in a suitable computer readable memory form. The data can be stored on a unit device, such as a flash memory drive or CD-ROM or on a server that can be accessed by a user via, e.g. a web interface.

In one embodiment, the invention provides a kit comprising one or more of the components described herein. In some embodiments, the kit comprises a vector system and instructions for using the kit. In some embodiments, the vector system includes a regulatory element operably linked to one or more engineered polynucleotides, such as those containing a muscle-specific targeting moiety and/or composition thereof, as described elsewhere herein and, optionally, a cargo molecule, which can optionally be operably linked to a regulatory element. The one or more engineered delivery system polynucleotides can be included on the same or different vectors as the cargo molecule in embodiments containing a cargo molecule within the kit.

In some embodiments, the kit comprises a vector system and instructions for using the kit. In some embodiments, the vector system comprises (a) a first regulatory element operably linked to a direct repeat sequence and one or more insertion sites for inserting one or more guide sequences up- or downstream (whichever applicable) of the direct repeat sequence, wherein when expressed, the guide sequence directs sequence-specific binding of a Cas9 CRISPR complex to a target sequence in a eukaryotic cell, wherein the Cas9 CRISPR complex comprises a Cas9 enzyme complexed with the guide sequence that is hybridized to the target sequence; and/or (b) a second regulatory element operably linked to an enzyme-coding sequence encoding said Cas9 enzyme comprising a nuclear localization sequence. Where applicable, a tracr sequence may also be provided. In some embodiments, the kit comprises components (a) and (b) located on the same or different vectors of the system. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the Cas9 enzyme comprises one or more nuclear localization sequences of sufficient strength to drive accumulation of said CRISPR enzyme in a detectable amount in the nucleus of a eukaryotic cell. In some embodiments, the CRISPR enzyme is a type V or VI CRISPR system enzyme. In some embodiments, the CRISPR enzyme is a Cas9 enzyme. In some embodiments, the Cas9 enzyme is derived from *Francisella tularensis* 1, *Francisella tularensis* subsp. *novicida, Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, Smithella sp. SCADC, Acidaminococcus sp. BV3L6, Lachnospiraceae bacterium MA2020, Candidatus Methanoplasma *termitum, Eubacterium eligens, Moraxella* bovoculi 237, Leptospira inadai, Lachnospiraceae bacterium ND2006, *Porphyromonas crevioricanis* 3, *Prevotella disiens*, or *Porphyromonas macacae* Cas9 (e.g., modified to have or be associated with at least one DD), and may include further alteration or mutation of the Cas9, and can be a chimeric Cas9. In some embodiments, the DD-CRISPR enzyme is codon-optimized for expression in a eukaryotic cell. In some embodiments, the DD-CRISPR enzyme directs cleavage of one or two strands at the location of the target sequence. In some embodiments, the DD-CRISPR enzyme lacks or substantially DNA strand cleavage activity (e.g., no more than 5% nuclease activity as compared with a wild type enzyme or enzyme not having the mutation or alteration that decreases nuclease activity). In some embodiments, the first regulatory element is a polymerase III promoter. In some embodiments, the second regulatory element is a polymerase II promoter. In some embodiments, the guide sequence is at least 16, 17, 18, 19, 20, 25 nucleotides, or between 16-30, or between 16-25, or between 16-20 nucleotides in length.

Methods of Use
General Discussion

The compositions including one or more of the muscle-specific targeting moieties, engineered muscle-specific delivery system, engineered viral capsids and particles, polynucleotides, polypeptides, vector(s), engineered cells of the present invention can be used generally to package and/or deliver one or more cargos to a recipient cell. In some embodiments, delivery is done in cell-specific manner based upon the specificity of the targeting moiety, such as in a muscle specific manner. In some embodiments, this is conferred by the tropism of the engineered viral capsid, which can be influenced at least in part by the inclusion of one or more RGD and/ord n-mer motifs described elsewhere herein. In some embodiments, the tropism is muscle specific. In some embodiments, compositions including one or more of the muscle-specific targeting moieties, engineered viral capsids and viral particles, can be administered to a subject or a cell, tissue, and/or organ and facilitate the transfer and/or integration of the cargo to the recipient cell. In other embodiments, engineered cells capable of producing compositions, such as polypeptides and other particles (e.g. engineered AAV capsids and viral particles), containing one or more of the muscle-specific targeting moieties can be generated from the polynucleotides, vectors, and vector systems etc., described herein. This includes without limitation, the engineered AAV capsid system molecules (e.g. polynucleotides, vectors, and vector systems, etc.). In some embodiments, the polynucleotides, vectors, and vector systems etc., described herein capable of generating the compositions, such as polypeptides and other particles (e.g. engineered AAV capsids and viral particles), containing one or more of the muscle-specific targeting moieties can be delivered to a cell or tissue, in vivo, ex vivo, or in vitro. In some embodiments, when delivered to a subject, the composition can transform a subject's cell in vivo or ex vivo to produce an engineered cell that can be capable of making a composition described herein that contains one or more of the muscle-specific targeting moieties described herein, including but not limited to the engineered AAV capsid particles, which can be released from the engineered cell and deliver cargo molecule(s) to a recipient cell in vivo or produce personalized engineered compositions (e.g. AAV capsid particles) for reintroduction into the subject from which the recipient cell was obtained.

In some embodiments, an engineered cell can be delivered to a subject, where it can release produced compositions of the present invention (including but not limited to engineered AAV capsid particles) such that they can then deliver a cargo (e.g. a cargo polynucleotide(s)) to a recipient cell. These general processes can be used in a variety of ways to treat and/or prevent disease or a symptom thereof in a subject, generate model cells, generate modified organisms, provide cell selection and screening assays, in bioproduction, and in other various applications.

In some embodiments, the compositions, such as polypeptides and other particles (e.g. engineered AAV capsids and viral particles), containing one or more of the muscle-specific targeting moieties) can be delivered to a subject or a cell, tissue, and/or organ. In this way they can be used to deliver any cargo they may contain or are associated with to a muscle cell.

In some embodiments, the engineered AAV capsid polynucleotides, vectors, and systems thereof can be used to generate engineered AAV capsid variant libraries that can be mined for variants with a desired cell-specificity. The description provided herein as supported by the various Examples can demonstrate that one having a desired cell-specificity in mind could utilize the present invention as described herein to obtain a capsid with the desired cell-specificity.

The subject invention may be used as part of a research program wherein there is transmission of results or data. A computer system (or digital device) may be used to receive, transmit, display and/or store results, analyze the data and/or results, and/or produce a report of the results and/or data and/or analysis. A computer system may be understood as a logical apparatus that can read instructions from media (e.g. software) and/or network port (e.g. from the internet), which can optionally be connected to a server having fixed media. A computer system may comprise one or more of a CPU, disk drives, input devices such as keyboard and/or mouse, and a display (e.g. a monitor). Data communication, such as transmission of instructions or reports, can be achieved through a communication medium to a server at a local or a remote location. The communication medium can include any means of transmitting and/or receiving data. For example, the communication medium can be a network connection, a wireless connection, or an internet connection. Such a connection can provide for communication over the World Wide Web. It is envisioned that data relating to the present invention can be transmitted over such networks or connections (or any other suitable means for transmitting information, including but not limited to mailing a physical report, such as a print-out) for reception and/or for review by a receiver. The receiver can be but is not limited to an individual, or electronic system (e.g. one or more computers, and/or one or more servers). In some embodiments, the computer system comprises one or more processors. Processors may be associated with one or more controllers, calculation units, and/or other units of a computer system, or implanted in firmware as desired. If implemented in software, the routines may be stored in any computer readable memory such as in RAM, ROM, flash memory, a magnetic disk, a laser disk, or other suitable storage medium. Likewise, this software may be delivered to a computing device via any known delivery method including, for example, over a communication channel such as a telephone line, the internet, a wireless connection, etc., or via a transportable medium, such as a computer readable disk, flash drive, etc. The various steps may be implemented as various blocks, operations, tools, modules and techniques which, in turn, may be implemented in hardware, firmware, software, or any combination of hardware, firmware, and/or software. When implemented in hardware, some or all of the blocks, operations, techniques, etc. may be implemented in, for example, a custom integrated circuit (IC), an application specific integrated circuit (ASIC), a field programmable logic array (FPGA), a programmable logic array (PLA), etc. A client-server, relational database architecture can be used in embodiments of the invention. A client-server architecture is a network architecture in which each computer or process on the network is either a client or a server. Server computers are typically powerful computers dedicated to managing disk drives (file servers), printers (print servers), or network traffic (network servers). Client computers include PCs (personal computers) or workstations on which users run applications, as well as example output devices as disclosed herein. Client computers rely on server computers for resources, such as files, devices, and even processing power. In some embodiments of the invention, the server computer handles all of the database functionality. The client computer can have software that handles all the front-end data management and can also receive data input from users. A machine readable medium comprising computer-executable code may take many forms, including but not limited to, a tangible storage medium, a carrier wave medium or physical transmission medium. Non-volatile storage media include, for example, optical or magnetic disks, such as any of the storage devices in any computer(s) or the like, such as may be used to implement the databases, etc. shown in the drawings. Volatile storage media include dynamic memory, such as main memory of such a computer platform. Tangible transmission media include coaxial cables; copper wire and fiber optics, including the wires that comprise a bus within a computer system. Carrier-wave transmission media may take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH-EPROM, any other memory chip or cartridge, a carrier wave transporting data or instructions, cables or links transporting such a carrier wave, or any other medium from which a computer may read programming code and/or data. Many of these forms of computer readable media may be involved in carrying one or more sequences of one or more instructions to a processor for execution. Accordingly, the invention comprehends performing any method herein-discussed and storing and/or transmitting data and/or results therefrom and/or analysis thereof, as well as products from performing any method herein-discussed, including intermediates.

Therapeutics

In some embodiments, the compositions containing one or more of the muscle-specific targeting moieties described herein, including, but not limited to the engineered AAV capsids, engineered viral particles, engineered cells, and/or formulations thereof described herein can be delivered to a subject in need thereof as a therapy for one or more diseases. In some embodiments, the disease to be treated is a genetic- or epigenetic-based disease. In some embodiments, the disease to be treated is not a genetic- or epigenetic-based disease. In some embodiments, one the compositions containing one or more of the muscle-specific targeting moieties described herein, including, but not limited to, the engineered viral capsids, viral particles, engineered cells, and/or formulations thereof described herein can be delivered to a subject in need thereof as a treatment or prevention (or as a part of a treatment or prevention) of a disease. It will be appreciated that the specific disease to be treated and/or prevented by delivery of a composition, formulation, cell and the like of the present invention, can be dependent on the cargo coupled to, attached to, contained in, or otherwise associated with the composition, formulation, cell and the like of the present invention.

Genetic diseases that can be treated are discussed in greater detail elsewhere herein (see e.g. discussion on Gene-modification based-therapies below). Other diseases include but are not limited to any of the following: cancer, Acubetivacter infections, actinomycosis, African sleeping sickness, AIDS/HIV, amoebiasis, Anaplasmosis, Angiostrongyliasis, Anisakiasis, Anthrax, Arcanobacterium haemolyticum infection, Argentine hemorrhagic fever, Ascariasis, Aspergillosis, Astrovirus infection, Babesiosis, Bacterial meningitis, Bacterial pneumonia, Bacterial vaginosis, Bacteroides infection, balantidiasis, Bartonellosis, Baylisascaris infection, BK virus infection, Black Piedra, Blastocystis, Blastomycosis, Bolivian hemorrhagic fever, Botulism, Brazilian hemorrhagic fever, brucellosis, Bubonic plague, Burkholderia infection, buruli ulcer, calicivirus invention, campylobacteriosis, Candidiasis, Capillariasis, Carrion's disease, Cat-scratch disease, cellulitis, Chagas Disease, Chancroid, Chickenpox, Chikungunya, *Chlamydia*, *Chlamydia pneumoniae*, Cholera, Chromoblastomycosis, Chytridiomycosis, Clonorchiasis, *Clostridium difficile* colitis, Coccidioidomycosis, Colorado tick fever, rhinovirus/coronavirus infection (common cold), Creutzfeldt-Jakob disease, Crimean-congo hemorrhagic fever, Cryptococcosis, Cryptosporidiosis, Cutaneous larva migrans (CLM), cyclosporiasis, cysticercosis, cytomegalovirus infection, Dengue fever, Desmodesmus infection, Dientamoebiasis, Diphtheria, Diphyllobothriasis, Dracunculiasis, Ebola, Echinococcosis, Ehrlichiosis, Enterobiasis, *Enterococcus* infection, Enterovirus infection, Epidemic typhus, Erythema Infectiosum, Exanthem subitum, Fascioliasis, Fasciolopsiasis, fatal familial insomnia, filariasis, *Clostridium perfringens* infection, *Fusobacterium* infection, Gas gangrene (clostridial myonecrosis), Geotrichosis, Gerstmann-Straussler-Scheinker syndrome, Giardiasis, Glanders, Gnathostomiasis, Gonorrhea, Granuloma inguinales, Group A streptococcal infection, Group B streptococcal infection, *Haemophilus influenzae* infection, Hand, foot, and mouth disease, hanta virus pulmonary syndrome, heartland virus disease, *Helicobacter pylori* infection, hemorrhagic fever with renal syndrome, Hendra virus infection, Hepatitis (all groups A, B, C, D, E), herpes simplex, histoplasmosis, hookworm infection, human bocavirus infection, human ewingii ehrlichiosis, Human granulocytic anaplasmosis, human metapneumovirus infection, human monocytic ehrlichiosis, human papilloma virus, Hymenolepiasis, Epstein-Barr infection, mononucleosis, influenza, isosporiasis, Kawasaki disease, Kingella kingae infection, Kuru, Lassa fever, Legionellosis (Legionnaire's disease and Potomac Fever), Leishmaniasis, Leprosy, Leptospirosis, Listeriosis, Lyme disease, lymphatic filariasis, lymphocytic choriomeningitis, Malaria, Marburg hemorrhagic fever, measles, Middle East respiratory syndrome, Melioidosis, meningitis, Meningococcal disease, Metagonimiasis, Microsporidiosis, Molluscum contagiosum, Monkeypox, Mumps, Murine typhus, *Mycoplasma* pneumonia, *Mycoplasma genitalium* infection, Mycetoma, Myiasis, Conjunctivitis, Nipah virus infection, Norovirus, Variant Creutzfeldt-Jakob disease, Nocardiosis, Onchocerciasis, Opisthorchiasis, Paracoccidioidomycosis, Paragonimiasis, Pasteurellosis, Pediculosis capitis, Pediculosis corporis, Pediculosis pubis, pelvic inflammatory disease, pertussis, plague, pneumococcal infection, pneumocystis pneumonia, pneumonia, poliomyelitis, prevotella infection, primary amoebic meningoencephalitis, progressive multifocal leukoencephalopathy, Psittacosis, Q fever, rabies, relapsing fever, respiratory syncytial virus infection, rhinovirus infection, rickettsial infection, Rickettsialpox, Rift Valley Fever, Rocky Mountain Spotted Fever, Rotavirus infection, Rubella, *Salmonellosis*, SARS, Scabies, Scarlet fever, Schistosomiasis, Sepsis, Shigellosis, Shingles, Smallpox, Sporotrichosis, Staphylococcal infection (including MRSA), strongyloidiasis, subacute sclerosing panencephalitis, Syphilis, Taeniasis, tetanus, *Trichophyton* species infection, Toxocariasis, Toxoplasmosis, Trachoma, Trichinosis, Trichuriasis, Tuberculosis, Tularemia, Typhoid Fever, Typhus Fever, *Ureaplasma urealyticum* infection, Valley fever, Venezuelan equine encephalitis, Venezuelan hemorrhagic fever, *Vibrio* species infection, Viral pneumonia, West Nile Fever, White Piedra, *Yersinia pseudotuberculosis*, Yersiniosis, Yellow fever, Zeaspora, Zika fever, Zygomycosis and combinations thereof.

Other diseases and disorders that can be treated using embodiments of the present invention include, but are not limited to, endocrine diseases (e.g. Type I and Type II diabetes, gestational diabetes, hypoglycemia. Glucagonoma, Goiter, Hyperthyroidism, hypothyroidism, thyroiditis, thyroid cancer, thyroid hormone resistance, parathyroid gland disorders, Osteoporosis, osteitis deformans, rickets, osteomalacia, hypopituitarism, pituitary tumors, etc.), skin conditions of infections and non-infectious origin, eye diseases of infectious or non-infectious origin, gastrointestinal disorders of infectious or non-infectious origin, cardiovascular diseases of infectious or non-infectious origin, brain and neuron diseases of infectious or non-infectious origin, nervous system diseases of infectious or non-infectious origin, muscle diseases of infectious or non-infectious origin, bone diseases of infectious or non-infectious origin, reproductive system diseases of infectious or non-infectious origin, renal system diseases of infectious or non-infectious origin, blood diseases of infectious or non-infectious origin, lymphatic system diseases of infectious or non-infectious origin, immune system diseases of infectious or non-infectious origin, mental-illness of infectious or non-infectious origin and the like.

In some embodiments, the disease to be treated is a muscle or muscle related disease or disorder, such as a genetic muscle disease or disorder.

Other diseases and disorders will be appreciated by those of skill in the art.

Adoptive Cell Therapies

Generally speaking, adoptive cell transfer involves the transfer of cells (autologous, allogeneic, and/or xenogeneic) to a subject. The cells may or may not be modified and/or otherwise manipulated prior to delivery to the subject.

In some embodiments, an engineered cell as described herein can be included in an adoptive cell transfer therapy. In some embodiments, an engineered cell as described herein can be delivered to a subject in need thereof. In some embodiments, the cell can be isolated from a subject, manipulated in vitro such that it contains and/or is capable of generating a composition of the present invention containing a muscle-specific targeting moiety described elsewhere herein (including but not limited to an engineered viral particle) described herein to produce an engineered cell and delivered back to the subject in an autologous manner or to a different subject in an allogeneic or xenogeneic manner. The cell isolated, manipulated, and/or delivered can be a eukaryotic cell. The cell isolated, manipulated, and/or delivered can be a stem cell. The cell isolated, manipulated, and/or delivered can be a differentiated cell. The cell isolated, manipulated, and/or delivered can be an immune cell, a blood cell, an endocrine cell, a renal cell, an exocrine cell, a nervous system cell, a vascular cell, a muscle cell, a urinary system cell, a bone cell, a soft tissue cell, a cardiac cell, a neuron, or an integumentary system cell. Other specific cell types will instantly be appreciated by one of ordinary skill in the art.

In some embodiments, the isolated cell can be manipulated such that it becomes an engineered cell as described elsewhere herein (e.g. contain and/or express one or more engineered delivery system molecules or vectors described elsewhere herein). Methods of making such engineered cells are described in greater detail elsewhere herein.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can be or involve the administration of $10^4$-$10^9$ cells per kg body weight including all integer values of cell numbers within those ranges. In some embodiments, $10^5$ to $10^6$ cells/kg are delivered Dosing in adoptive cell therapies may for example involve administration of from $10^6$ to $10^9$ cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tissue. In some embodiments, the tissue can be a tumor.

To guard against possible adverse reactions, engineered cells can be equipped with a transgenic safety switch, in the form of a transgene that renders the cells vulnerable to exposure to a specific signal. For example, the herpes simplex viral thymidine kinase (TK) gene may be used in this way, for example by introduction into the engineered cell similar to that discussed in Greco, et al., improving the safety of cell therapy with the TK-suicide gene. Front. Pharmacol. 2015; 6:95. In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-

1683; Sadelain M, The New England Journal of Medicine 2011; 365:1735-173; Ramos et al., Stem Cells 28(6): 1107-15(2010)).

Methods of modifying isolated cells to obtain the engineered cells with the desired properties are described elsewhere herein. In some embodiments, the methods can include genome modification, including, but not limited to, genome editing using a CRISPR-Cas system to modify the cell. This can be in addition to introduction of an e.g., engineered AAV capsid system molecule describe elsewhere herein.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1; 112(12): 4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic cells, such as engineered cells described herein. Therefore, to effectively use an adoptive immunotherapy approach in these conditions, the introduced cells would need to be resistant to the immunosuppressive treatment. Thus, in a particular embodiment, the present invention further comprises a step of modifying the engineered cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to engineered cells for adoptive cell therapy by inactivating the target of the immunosuppressive agent in engineered cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDLI or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy? Biochem Soc Trans. 2016 Apr. 15; 44(2): 356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

International Patent Publication No. WO2014172606 relates to the use of MTI and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCDI, ICOS (CD278), PDL1, KIR, LAG3, HAVCR2, BTLA, CD160, TIGIT, CD96, CRTAM, LAIRI, SIGLEC7, SIGLEC9, CD244(2B4), TNFRSF10B, TNFRSF10A, CASP8, CASP10, CASP3, CASP6, CASP7, FADD, FAS, TGFBRII, TGFRBRI, SMAD2, SMAD3, SMAD4, SMAD10, SKI, SKIL, TGIF1, IL1ORA, ILIORB, HMOX2, IL6R, IL6ST, EIF2AK4, CSK, PAGI, SITI, FOXP3, PRDMI, BATF, VISTA, GUCY1A2, GUCY1A3, GUCY1B2, GUCY1B3, MTI, MT2, CD40, OX40, CD137, GITR, CD27, SHP-1 or TIM-3. In some embodiments, the gene locus involved in the expression of PD-1 or CTLA-4 genes is targeted. In some embodiments, combinations of genes are targeted, such as but not limited to PD-1 and TIGIT.

In some embodiments, at least two genes are edited. Pairs of genes may include, but are not limited to PD1 and TCRα, PD1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ.

Whether prior to or after genetic or other modification of the engineered cells (such as engineered T cells (e.g. the isolated cell is a T cell), the engineered cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. The engineered cells can be expanded in vitro or in vivo.

In some embodiments, the method comprises editing the engineered cells ex vivo by a suitable gene modification method described elsewhere herein (e.g. gene editing via a CRISPR-Cas system) to eliminate potential alloreactive TCRs or other receptors to allow allogeneic adoptive transfer. In some embodiments, T cells are edited ex vivo by a CRISPR-Cas system or other suitable genome modification technique to knock-out or knock-down an endogenous gene encoding a TCR (e.g., an αβ TCR) or other relevant receptor to avoid graft-versus-host-disease (GVHD). In some embodiments, where the engineered cells are T cells, the engineered cells are edited ex vivo by CRISPR or other appropriate gene modification method to mutate the TRAC locus. In some embodiments, T cells are edited ex vivo via a CRISPR-Cas system using one or more guide sequences targeting the first exon of TRAC. See Liu et al., Cell Research 27:154-157 (2017). In some embodiments, the first exon of TRAC is modified using another appropriate gene modification method. In some embodiments, the method comprises use of CRISPR or other appropriate method to knock-in an exogenous gene encoding a CAR or a TCR into the TRAC locus, while simultaneously knocking-out the endogenous TCR (e.g., with a donor sequence encoding a self-cleaving P2A peptide following the CAR cDNA). See Eyquem et al., Nature 543:113-117(2017). In some embodiments, the exogenous gene comprises a promoter-less CAR-encoding or TCR-encoding sequence which is inserted operably downstream of an endogenous TCR promoter.

In some embodiments, the method comprises editing the engineered cell, e.g. engineered T cells, ex vivo via a CRISPR-Cas system to knock-out or knock-down an endogenous gene encoding an HLA-I protein to minimize immunogenicity of the edited cells, e.g. engineered T cells. In some embodiments, engineered T cells can be edited ex vivo via a CRISPR-Cas system to mutate the beta-2 microglobulin (B2M) locus. In some embodiments, engineered cell, e.g. engineered T cells, are edited ex vivo via a CRISPR-Cas system using one or more guide sequences targeting the first exon of B2M. The first exon of B2M can also be modified using another appropriate modification method. See Liu et al., Cell Research 27:154-157 (2017). The first exon of B2M can also be modified using another appropriate modification method, which will be appreciated by those of ordinary skill in the art. In some embodiments, the method comprises use a CRISPR-Cas system to knock-in an exogenous gene encoding a CAR or a TCR into the B2M locus, while simultaneously knocking-out the endogenous B2M (e.g., with a donor sequence encoding a self-cleaving P2A peptide following the CAR cDNA). See Eyquem et al., Nature 543:113-117 (2017). This can also be accomplished using another appropriate modification method, which will be appreciated by those of ordinary skill in the art. In some embodiments, the exogenous gene comprises a promoter-less CAR-encoding or TCR-encoding sequence which is inserted operably downstream of an endogenous B2M promoter.

In some embodiments, the method comprises editing the engineered cell, e.g. engineered T cells, ex vivo via a CRISPR-Cas system to knock-out or knock-down an endogenous gene encoding an antigen targeted by an exogenous CAR or TCR. This can also be accomplished using another appropriate modification method, which will be appreciated by those of ordinary skill in the art. In some embodiments, the engineered cells, such as engineered T cells, are edited ex vivo via a CRISPR-Cas system to knock-out or knock-down the expression of a tumor antigen selected from human telomerase reverse transcriptase (hTERT), survivin, mouse double minute 2 homolog (MDM2), cytochrome P450 1B 1 (CYPIB), HER2/neu, Wilms' tumor gene 1 (WT1), livin, alphafetoprotein (AFP), carcinoembryonic antigen (CEA), mucin 16 (MUC16), MUC1, prostate-specific membrane antigen (PSMA), p53 or cyclin (DI) (see WO2016/011210). This can also be accomplished using another appropriate modification method, which will be appreciated by those of ordinary skill in the art. In some embodiments, the engineered cells, such as engineered T cells are edited ex vivo via a CRISPR-Cas system to knock-out or knock-down the expression of an antigen selected from B cell maturation antigen (BCMA), transmembrane activator and CAML Interactor (TACI), or B-cell activating factor receptor (BAFF-R), CD38, CD138, CS-1, CD33, CD26, CD30, CD53, CD92, CD100, CD148, CD150, CD200, CD261, CD262, or CD362 (see WO2017/011804). This can also be accomplished using another appropriate modification method, which will be appreciated by those of ordinary skill in the art.

Gene Drives

The present invention also contemplates use of the compositions containing a muscle-specific targeting moiety described elsewhere herein, formulations thereof, cells thereof, vector systems, and the like to generate a gene drive via delivery of one or more cargo polynucleotides or production of a composition containing a muscle-specific targeting moiety described elsewhere herein (including but not limited to engineered AAV capsid particles) with one or more cargo polynucleotides capable of producing a gene drive. In some embodiments, the gene drive can be a Cas-mediated RNA-guided gene drive e.g. Cas-to provide RNA-guided gene drives, for example in systems analogous to gene drives described in International Patent Publication WO 2015/105928. Systems of this kind may for example provide methods for altering eukaryotic germline cells, by introducing into the germline cell a nucleic acid sequence encoding an RNA-guided DNA nuclease and one or more guide RNAs. The guide RNAs may be designed to be complementary to one or more target locations on genomic DNA of the germline cell. The nucleic acid sequence encoding the RNA guided DNA nuclease and the nucleic acid sequence encoding the guide RNAs may be provided on constructs between flanking sequences, with promoters arranged such that the germline cell may express the RNA guided DNA nuclease and the guide RNAs, together with any desired cargo-encoding sequences that are also situated between the flanking sequences. The flanking sequences will typically include a sequence which is identical to a corresponding sequence on a selected target chromosome, so that the flanking sequences work with the components encoded by the construct to facilitate insertion of the foreign nucleic acid construct sequences into genomic DNA at a target cut site by mechanisms such as homologous recombination, to render the germline cell homozygous for the foreign nucleic acid sequence. In this way, gene-drive systems are capable of introgressing desired cargo genes throughout a breeding population (Gantz et al., 2015, Highly efficient Cas9-mediated gene drive for population modification of the malaria vector mosquito *Anopheles stephensi*, PNAS 2015, published ahead of print Nov. 23, 2015, doi: 10.1073/pnas.1521077112; Esvelt et al., 2014, Concerning RNA-guided gene drives for the alteration of wild populations eLife 2014; 3: e03401). In select embodiments, target sequences may be selected which have few potential off-target sites in a genome. Targeting multiple sites within a target locus, using multiple guide RNAs, may increase the cutting frequency and hinder the evolution of drive resistant alleles. Truncated guide RNAs may reduce off-target cutting. Paired nickases may be used instead of a single nuclease, to further increase specificity. Gene drive constructs (such as gene drive engineered delivery system constructs) may include cargo sequences encoding transcriptional regulators, for example to activate homologous recombination genes and/or repress non-homologous end-joining. Target sites may be chosen within an essential gene, so that non-homologous end-joining events may cause lethality rather than creating a drive-resistant allele. The gene drive constructs can be engineered to function in a range of hosts at a range of temperatures (Cho et al. 2013, Rapid and Tunable Control of Protein Stability in *Caenorhabditis elegans* Using a Small Molecule, PLOS ONE 8(8): e72393. doi: 10.1371/journal.pone.0072393).

Transplantation and Xenotransplantation

The compositions containing a muscle-specific targeting moiety described elsewhere herein, formulations thereof, cells thereof, vector systems, and the like, can be used to deliver cargo polynucleotides and/or otherwise be involved in modifying tissues for transplantation between two different persons (transplantation) or between species (xenotransplantation). Such techniques for generation of transgenic animals is described elsewhere herein. Interspecies transplantation techniques are generally known in the art. For example, RNA-guided DNA nucleases can be delivered using via engineered viral particles or other delivery vehicles, polynucleotides, vectors, and/or engineered cells of the present invention described herein and can be used to knockout, knockdown or disrupt selected genes in an organ for transplant (e.g. ex vivo (e.g. after harvest but before transplantation) or in vivo (in donor or recipient)), animal, such as a transgenic pig (such as the human heme oxygenase-1 transgenic pig line), for example by disrupting expression of genes that encode epitopes recognized by the human immune system, i.e. xenoantigen genes. Candidate porcine genes for disruption may for example include a (1,3)-galactosyltransferase and cytidine monophosphate-N-acetylneuraminic acid hydroxylase genes (see International Patent Publication WO 2014/066505). In addition, genes encoding endogenous retroviruses may be disrupted, for example the genes encoding all porcine endogenous retroviruses (see Yang et al., 2015, Genome-wide inactivation of porcine endogenous retroviruses (PERVs), Science 27 Nov. 2015: Vol. 350 no. 6264 pp. 1101-1104). In addition, RNA-guided DNA nucleases may be used to target a site for integration of additional genes in xenotransplant donor animals, such as a human CD55 gene to improve protection against hyperacute rejection.

Where it is interspecies transplantation (such as human to human) the composition compositions containing a muscle-specific targeting moiety described elsewhere herein, or composition containing a muscle-specific targeting moiety (e.g. an engineered AAV capsid system molecule, vectors, engineered cells, and/or engineered delivery particles described herein), can be used to deliver cargo polynucleotides and/or otherwise be involved to modify the tissue to be transplanted. In some embodiments, the modification can include modifying one or more HLA antigens or other tissue type determinants, such that the immunogenic profile is more similar or identical to the recipient's immunogenic profile than to the donor's so as to reduce the occurrence of rejection by the recipient. Relevant tissue type determinants are known in the art (such as those used to determine organ matching) and techniques to determine the immunogenic profile (which is made up of the expression signature of the tissue type determinants) are generally known in the art.

In some embodiments, the donor (such as before harvest) or recipient (after transplantation) can receive one or more of the compositions containing a muscle-specific targeting moiety described elsewhere herein, formulations thereof, cells thereof, vector systems, engineered muscle-specific delivery system molecules, vectors, engineered cells, and/or engineered delivery particles described herein that are capable of modifying the immunogenic profile of the transplanted cells, tissue, and/or organ. In some embodiments, the transplanted cells, tissue, and/or organ can be harvested from the donor and the compositions containing a muscle-specific targeting moiety described elsewhere herein, formulations thereof, cells thereof, vector systems, engineered muscle-specific delivery system molecules, vectors, engineered cells, and/or engineered delivery particles described herein capable of modifying the harvested cells, tissue, and/or organ to be, for example, less immunogenic or be modified to have some specific characteristic when transplanted in the recipient can be delivered to the harvested cells, tissue, and/or organ ex vivo. After delivery the cells, tissue, and/or organs can be transplanted into the donor.

Gene Modification and Treatment of Diseases with Genetic or Epigenetic Aspects

The engineered muscle-specific delivery system molecules, vectors, engineered cells, and/or engineered delivery particles described herein containing a muscle-specific targeting moiety can be used to modify genes or other polynucleotides and/or treat diseases with genetic and/or epigenetic aspects. As described elsewhere herein the cargo molecule can be a polynucleotide that can be delivered to a cell and, in some embodiments, be integrated into the genome of the cell. In some embodiments, the cargo molecule(s) can be one or more CRISPR-Cas system components. In some embodiments, the CRISPR-Cas components, when delivered by a composition or formulation thereof of the present invention, such as an engineered muscle-specific viral particle or other engineered delivery vehicle described herein, can be optionally expressed in the recipient cell and act to modify the genome of the recipient cell in a sequence specific manner. In some embodiments, the cargo molecules that can be packaged and delivered by the engineered viral particles or other engineered delivery vehicles and/or compositions described herein can facilitate/mediate genome modification via a method that is not dependent on CRISPR-Cas. Such non-CRISPR-Cas genome modification systems will instantly be appreciated by those of ordinary skill in the art and are also, at least in part, described elsewhere herein. In some embodiments, modification is at a specific target sequence. In other embodiments, modification is at locations that appear to be random throughout the genome.

Examples of disease-associated genes and polynucleotides and disease specific information is available from McKusick-Nathans Institute of Genetic Medicine, Johns Hopkins University (Baltimore, Md.) and National Center for Biotechnology Information, National Library of Medicine (Bethesda, Md.), available on the World Wide Web. Any of these can be appropriate to be treated by one or more of the methods described herein. In some embodiments, the disease is a muscle disease or disorder, neuro-muscular disease or disorder, or a cardiomyopathy. In some embodiments, the disease or disorder selected from any one or more of the following:

(a) an auto immune disease;
(b) a cancer;
(c) a muscular dystrophy;
(d) a neuro-muscular disease;
(e) a sugar or glycogen storage disease;
(f) an expanded repeat disease;
(g) a dominant negative disease;
(h) a cardiomyopathy;
(i) a viral disease;
(j) a progeroid disease; or
(k) any combination thereof.

In some embodiments, the expanded repeat disease is Huntington's disease, a Myotonic Dystrophy, or Facioscapulohumeral muscular dystrophy (FSHD). In some embodiments, the muscular dystrophy is Duchene muscular dystrophy, Becker Muscular dystrophy, a Limb-Girdle muscular dystrophy, an Emery Dreifuss muscular dystrophy, a myotonic dystrophy, or FSHD. In some embodiments, the myotonic dystrophy is Type 1 or Type 2. In some embodiments, the LGMD is subtype 2A, 2B, 2C, 2D, 2E, or 2L. In some embodiments, the cardiomyopathy is dilated cardiomyopathy, hypertrophic cardiomyopathy, DMD-associated cardiomyopathy, or Dannon disease. In some embodiments, the sugar or glycogen storage disease is a MPS type III disease or Pompe disease. In some embodiments, the MPS type III disease, is MPS Type IIIA, IIIB, IIIC, or IIID. In some embodiments, the neuro-muscular disease is Charcot-Marie-Tooth disease or Friedreich's Ataxia.

More specifically, mutations in these genes and pathways can result in production of improper proteins or proteins in improper amounts which affect function. Further examples of genes, diseases and proteins are hereby incorporated by reference from U.S. Provisional application 61/736,527 filed Dec. 12, 2012. Such genes, proteins and pathways may be the target polynucleotide of a CRISPR complex of the present invention. Examples of disease-associated and/or cell function-associated genes and polynucleotides are listed in Tables A and B.

TABLE A

Exemplary Genetic and Other Diseases and Associated Genes

| Disease Name | Primary Tissues or System Affected | Additional Tissues/ Systems Affected | Genes |
|---|---|---|---|
| Achondroplasia | Bone and Muscle | | fibroblast growth factor receptor 3 (FGFR3) |
| Achromatopsia | eye | | CNGA3, CNGB3, GNAT2, PDE6C, PDE6H, ACHM2, ACHM3, |
| Acute Renal Injury | kidney | | NFkappaB, AATF, p85alpha, FAS, Apoptosis cascade elements (e.g. FASR, Caspase 2, 3, 4, 6, 7, 8, 9, 10, AKT, TNF alpha, IGF1, IGF1R, RIPK1), p53 |
| Age Related Macular Degeneration | eye | | Abcr; CCL2; CC2; CP (ceruloplasmin); Timp3; cathepsinD; VLDLR, CCR2 |
| AIDS | Immune System | | KIR3DL1, NKAT3, NKB1, AMB11, KIR3DS1, IFNG, CXCL12, SDF1 |
| Albinism (including oculocutaneous albinism (types 1-7) and ocular albinism) | Skin, hair, eyes, | | TYR, OCA2, TYRP1, and SLC45A2, SLC24A5 and C10orf11 |
| Alkaptonuria | Metabolism of amino acids | Tissues/organs where homogentisic acid accumulates, particularly cartilage (joints), heart valves, kidneys | HGD |
| alpha-1 antitrypsin deficiency (AATD or A1AD) | Lung | Liver, skin, vascular system, kidneys, GI | SERPINA1, those set forth in WO2017165862, PiZ allele |
| ALS | CNS | | SOD1; ALS2; ALS3; ALS5; ALS7; STEX; FUS; TARDBP; VEGF (VEGF-a; VEGF-b; VEGF-c); DPP6; NEFH, PTGS1, SLC1A2, TNFRSF10B, PRPH, HSP90AA1, CRIA2, IFNG, AMPA2 S100B, FGF2, AOX1, CS, TXN, RAPHJ1, MAP3K5, NBEAL1, GPX1, ICA1L, RAC1, MAPT, ITPR2, ALS2CR4, GLS, ALS2CR8, CNTFR, ALS2CR11, FOLH1, FAM117B, P4HB, CNTF, SQSTM1, STRADB, NAIP, NLR, YWHAQ, SLC33A1, TRAK2, SCA1, NIF3L1, NIF3, PARD3B, COX8A, CDK15, HECW1, HECT, C2, WW 15, NOS1, MET, SOD2, HSPB1, NEFL, CTSB, ANG, HSPA8, RNase A, VAPB, VAMP, SNCA, alpha HGF, CAT, ACTB, NEFM, TH, BCL2, FAS, CASP3, CLU, SMN1, G6PD, BAX, HSF1, RNF19A, JUN, ALS2CR12, HSPA5, MAPK14, APEX1, TXNRD1, NOS2, TIMP1, CASP9, XIAP, GLG1, EPO, VEGFA, ELN, GDNF, NFE2L2, SLC6A3, HSPA4, APOE, PSMB8, DCTN2, TIMP3, KIFAP3, SLC1A1, SMN2, CCNC, STUB1, ALS2, PRDX6, SYP, CABIN1, CASP1, GART, CDK5, ATXN3, RTN4, C1QB, VEGFC, HTT, PARK7, XDH, |

TABLE A-continued

Exemplary Genetic and Other Diseases and Associated Genes

| Disease Name | Primary Tissues or System Affected | Additional Tissues/ Systems Affected | Genes |
|---|---|---|---|
| | | | GFAP, MAP2, CYCS, FCGR3B, CCS, UBL5, MMP9m SLC18A3, TRPM7, HSPB2, AKT1, DEERL1, CCL2, NGRN, GSR, TPPP3, APAF1, BTBD10, GLUD1, CXCR4, S:C1A3, FLT1, PON1, AR, LIF, ERBB3, :GA:S1, CD44, TP53, TLR3, GRIA1, GAPDH, AMPA, GRIK1, DES, CHAT, FLT4, CHMP2B, BAG1, CHRNA4, GSS, BAK1, KDR, GSTP1, OGG1, IL6 |
| Alzheimer's Disease | Brain | | E1; CHIP; UCH; UBB; Tau; LRP; PICALM; CLU; PS1; SORL1; CR1; VLDLR; UBA1; UBA3; CHIP28; AQP1; UCHL1; UCHL3; APP, AAA, CVAP, AD1, APOE, AD2, DCP1, ACE1, MPO, PACIP1, PAXIP1L, PTIP, A2M, BLMH, BMH, PSEN1, AD3, ALAS2, ABCA1, BIN1, BDNF, BTNL8, C1ORF49, CDH4, CHRNB2, CKLFSF2, CLEC4E, CR1L, CSF3R, CST3, CYP2C, DAPK1, ESR1, FCAR, FCGR3B, FFA2, FGA, GAB2, GALP, GAPDHS, GMPB, HP, HTR7, IDE, IF127, IFI6, IFIT2, IL1RN, IL-1RA, IL8RA, IL8RB, JAG1, KCNJ15, LRP6, MAPT, MARK4, MPHOSPH1, MTHFR, NBN, NCSTN, NIACR2, NMNAT3, NTM, ORM1, P2RY13, PBEF1, PCK1, PICALM, PLAU, PLXNC1, PRNP, PSEN1, PSEN2, PTPRA, RALGPS2, RGSL2, SELENBP1, SLC25A37, SORL1, Mitoferrin-1, TF, TFAM, TNF, TNFRSF10C, UBE1C |
| Amyloidosis | | | APOA1, APP, AAA, CVAP, AD1, GSN, FGA, LYZ, TTR, PALB |
| Amyloid neuropathy | | | TTR, PALB |
| Anemia | Blood | | CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT |
| Angelman Syndrome | Nervous system, brain | | UBE3A |
| Attention Deficit Hyperactivity Disorder (ADHD) | Brain | | PTCHD1 |
| Autoimmune lymphoproliferative syndrome | Immune system | | TNFRSF6, APT1, FAS, CD95, ALPS1A |
| Autism, Autism spectrum disorders (ASDs), including Asperger's and a general diagnostic category called Pervasive Developmental Disorders (PDDs) | Brain | | PTCHD1; Mecp2; BZRAP1; MDGA2; Sema5A; Neurexin 1; GLO1, RTT, PPMX, MRX16, RX79, NLGN3, NLGN4, KIAA1260, AUTSX2, FMRI, FMR2; FXR1; FXR2; MGLUR5, ATP10C, CDH10, GRM6, MGLUR6, CDH9, CNTN4, NLGN2, CNTNAP2, SEMA5A, DHCR7, NLGN4X, NLGN4Y, DPP6, NLGN5, EN2, NRCAM, MDGA2, NRXN1, FMR2, AFF2, FOXP2, OR4M2, OXTR, FXR1, FXR2, PAH, GABRA1, PTEN, GABRA5, PTPRZ1, GABRB3, GABRG1, HIRIP3, SEZ6L2, HOXA1, SHANK3, IL6, SHBZRAP1, LAMB1, SLC6A4, SERT, MAPK3, TAS2R1, MAZ, TSC1, MDGA2, TSC2, MECP2, UBE3A, WNT2, see also 20110023145 |

TABLE A-continued

Exemplary Genetic and Other Diseases and Associated Genes

| Disease Name | Primary Tissues or System Affected | Additional Tissues/ Systems Affected | Genes |
|---|---|---|---|
| autosomal dominant polycystic kidney disease (ADPKD)- (includes diseases such as von Hippel-Lindau disease and tubreous sclerosis complex disease) | kidney | liver | PKD1, PKD2 |
| Autosomal Recessive Polycystic Kidney Disease (ARPKD) | kidney | liver | PKDH1 |
| Ataxia-Telangiectasia (a.k.a Louis Bar syndrome) | Nervous system, immune system | various | ATM |
| B-Cell Non-Hodgkin Lymphoma | | | BCL7A, BCL7 |
| Bardet-Biedl syndrome | Eye, musculoskeletal system, kidney, reproductive organs | Liver, ear, gastrointestinal system, brain | ARL6, BBS1, BBS2, BBS4, BBS5, BBS7, BBS9, BBS10, BBS12, CEP290, INPP5E, LZTFL1, MKKS, MKS1, SDCCAG8, TRIM32, TTC8 |
| Bare Lymphocyte Syndrome | blood | | TAPBP, TPSN, TAP2, ABCB3, PSF2, RING11, MHC2TA, C2TA, RFX5, RFXAP, RFX5 |
| Barter's Syndrome (types I, II, III, IVA and B, and V) | kidney | | SLC12A1 (type I), KCNJ1 (type II), CLCNKB (type III), BSND (type IV A), or both the CLCNKA CLCNKB genes (type IV B), CASR (type V). |
| Becker muscular dystrophy | Muscle | | DMD, BMD, MYF6 |
| Best Disease (Vitelliform Macular Dystrophy type 2) | eye | | VMD2 |
| Bleeding Disorders | blood | | TBXA2R, P2RX1, P2X1 |
| Blue Cone Monochromacy | eye | | OPN1LW, OPN1MW, and LCR |
| Breast Cancer | Breast tissue | | BRCA1, BRCA2, COX-2 |
| Bruton's Disease (aka X-linked Agammglobulinemia) | Immune system, specifically B cells | | BTK |
| Cancers (e.g., lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DLCL), multiple myeloma, renal cell carcinoma (RCC), neuroblastoma, colorectal cancer, breast cancer, ovarian cancer, melanoma, sarcoma, prostate cancer, lung cancer, esophageal cancer, hepatocellular carcinoma, pancreatic cancer, astrocytoma, mesothelioma, head and neck cancer, and medulloblastoma | Various | | FAS, BID, CTLA4, PDCD1, CBLB, PTPN6, TRAC, TRBC, those described in WO2015048577 |
| Cardiovascular Diseases | heart | Vascular system | IL1B, XDH, TP53, PTGS, MB, IL4, ANGPT1, ABCGu8, CTSK, PTGIR, KCNJ11, INS, CRP, PDGFRB, CCNA2, PDGFB, KCNJ5, KCNN3, CAPN10, ADRA2B, ABCG5, PRDX2, CPAN5, PARP14, MEX3C, ACE, RNF, IL6, TNF, STN, SERPINE1, ALB, ADIPOQ, APOB, APOE, LEP, MTHFR, APOA1, EDN1, NPPB, NOS3, PPARG, PLAT, PTGS2, CETP, AGTR1, HMGCR, IGF1, SELE, REN, PPARA, PON1, KNG1, CCL2, LPL, VWF, F2, ICAM1, TGFB, NPPA, IL10, EPO, SOD1, VCAM1, IFNG, LPA, MPO, ESR1, MAPK, HP, F3, CST3, COG2, MMP9, SERPINC1, F8, HMOX1, APOC3, IL8, PROL1, CBS, NOS2, TLR4, SELP, ABCA1, AGT, LDLR, GPT, VEGFA, NR3C2, IL18, NOS1, NR3C1, FGB, HGF, ILIA, AKT1, LIPC, HSPD1, MAPK14, SPP1, ITGB3, CAT, UTS2, THBD, F10, CP, |

TABLE A-continued

Exemplary Genetic and Other Diseases and Associated Genes

| Disease Name | Primary Tissues or System Affected | Additional Tissues/ Systems Affected | Genes |
|---|---|---|---|
| | | | TNFRSF11B, EGFR, MMP2, PLG, NPY, RHOD, MAPK8, MYC, FN1, CMA1, PLAU, GNB3, ADRB2, SOD2, F5, VDR, ALOX5, HLA-DRB1, PARP1, CD40LG, PON2, AGER, IRS1, PTGS1, ECE1, F7, IRMN, EPHX2, IGFBP1, MAPK10, FAS, ABCB1, JUN, IGFBP3, CD14, PDE5A, AGTR2, CD40, LCAT, CCR5, MMP1, TIMP1, ADM, DYT10, STAT3, MMP3, ELN, USF1, CFH, HSPA4, MMP12, MME, F2R, SELL, CTSB, ANXA5, ADRB1, CYBA, FGA, GGT1, LIPG, HIF1A, CXCR4, PROC, SCARB1, CD79A, PLTP, ADD1, FGG, SAA1, KCNH2, DPP4, NPR1, VTN, KIAA0101, FOS, TLR2, PPIG, IL1R1, AR, CYP1A1, SERPINA1, MTR, RBP4, APOA4, CDKN2A, FGF2, EDNRB, ITGA2, VLA-2, CABIN1, SHBG, HMGB1, HSP90B2P, CYP3A4, GJA1, CAV1, ESR2, LTA, GDF15, BDNF, CYP2D6, NGF, SP1, TGIF1, SRC, EGF, PIK3CG, HLA-A, KCNQ1, CNR1, FBN1, CHKA, BEST1, CTNNB1, IL2, CD36, PRKAB1, TPO, ALDH7A1, CX3CR1, TH, F9, CH1, TF, HFE, IL17A, PTEN, GSTM1, DMD, GATA4, F13A1, TTR, FABP4, PON3, APOC1, INSR, TNFRSF1B, HTR2A, CSF3, CYP2C9, TXN, CYP11B2, PTH, CSF2, KDR, PLA2G2A, THBS1, GCG, RHOA, ALDH2, TCF7L2, NFE2L2, NOTCH1, UGT1A1, IFNA1, PPARD, SIRT1, GNHR1, PAPPA, ARR3, NPPC, AHSP, PTK2, IL13, MTOR, ITGB2, GSTT1, IL6ST, CPB2, CYP1A2, HNF4A, SLC64A, PLA2G6, TNFSF11, SLC8A1, F2RL1, AKR1A1, ALDH9A1, BGLAP, MTTP, MTRR, SULT1A3, RAGE, C4B, P2RY12, RNLS, CREB1, POMC, RAC1, LMNA, CD59, SCM5A, CYP1B1, MIF, MMP13, TIMP2, CYP19A1, CUP21A2, PTPN22, MYH14, MBL2, SELPLG, AOC3, CTSL1, PCNA, IGF2, ITGB1, CAST, CXCL12, IGHE, KCNE1, TFRC, COL1A1, COL1A2, IL2RB, PLA2G10, ANGPT2, PROCR, NOX4, HAMP, PTPN11, SLCA1, IL2RA, CCL5, IRF1, CF:AR, CA:CA, EIF4E, GSTP1, JAK2, CYP3A5, HSPG2, CCL3, MYD88, VIP, SOAT1, ADRBK1, NR4A2, MMP8, NPR2, GCH1, EPRS, PPARGC1A, F12, PECAM1, CCL4, CERPINA34, CASR, FABP2, TTF2, PROS1, CTF1, SGCB, YME1L1, CAMP, ZC3H12A, AKR1B1, MMP7, AHR, CSF1, HDAC9, CTGF, KCNMA1, UGT1A, PRKCA, COMT, S100B, EGR1, PRL, IL15, DRD4, CAMK2G, SLC22A2, CCL11, PGF, THPO, GP6, TACR1, NTS, HNF1A, SST, KCDN1, LOC646627, TBXAS1, CUP2J2, TBXA2R, ADH1C, ALOX12, AHSG, BHMT, GJA4, SLC25A4, ACLY, ALOX5AP, NUMA1, CYP27B1, CYSLTR2, SOD3, LTC4S, UCN, GHRL, APOC2, CLEC4A, |

TABLE A-continued

Exemplary Genetic and Other Diseases and Associated Genes

| Disease Name | Primary Tissues or System Affected | Additional Tissues/ Systems Affected | Genes |
|---|---|---|---|
| | | | KBTBD10, TNC, TYMS, SHC1, LRP1, SOCS3, ADH1B, KLK3, HSD11B1, VKORC1, SERPINB2, TNS1, RNF19A, EPOR, ITGAM, PITX2, MAPK7, FCGR3A, LEEPR, ENG, GPX1, GOT2, HRH1, NR112, CRH, HTR1A, VDAC1, HPSE, SFTPD, TAP2, RMF123, PTK2Bm NTRK2, IL6R, ACHE, GLP1R, GHR, GSR, NQO1, NR5A1, GJB2, SLC9A1, MAOA, PCSK9, FCGR2A, SERPINF1, EDN3, UCP2, TFAP2A, C4BPA, SERPINF2, TYMP, ALPP, CXCR2, SLC3A3, ABCG2, ADA, JAK3, HSPA1A, FASN, FGF1, F11, ATP7A, CR1, GFPA, ROCK1, MECP2, MYLK, BCHE, LIPE, ADORA1, WRN, CXCR3, CD81, SMAD7, LAMC2, MAP3K5, CHGA, IAPP, RHO, ENPP1, PTHLH, NRG1, VEGFC, ENPEP, CEBPB, NAGLU,. F2RL3, CX3CL1, BDKRB1, ADAMTS13, ELANE, ENPP2, CISH, GAST, MYOC, ATP1A2, NF1, GJB1, MEF2A, VCL, BMPR2, TUBB, CDC42, KRT18, HSF1, MYB, PRKAA2, ROCK2, TFP1, PRKG1, BMP2, CTNND1, CTH, CTSS, VAV2, NPY2R, IGFBP2, CD28, GSTA1, PPIA, APOH, S100A8, IL11, ALOX15, FBLN1, NR1H3, SCD, GIP, CHGB, PRKCB, SRD5A1,HSD11B2, CALCRL, GALNT2, ANGPTL4, KCNN4, PIK3C2A, HBEGF, CYP7A1, HLA-DRB5, BNIP3, GCKR, S100A12, PADI4, HSPA14, CXCR1, H19, KRTAP19-3, IDDM2, RAC2, YRY1, CLOCK, NGFR, DBH, CHRNA4, CACNA1C, PRKAG2, CHAT, PTGDS, NR1H2, TEK, VEGFB, MEF2C, MAPKAPK2, TNFRSF11A, HSPA9, CYSLTR1, MATIA, OPRL1, IMPA1, CLCN2, DLD, PSMA6, PSMB8, CHI3L1, ALDH1B1, PARP2,STAR, LBP, ABCC6, RGS2, EFNB2, GJB6, APOA2, AMPD1, DYSF, FDFT1, EMD2, CCR6, GJB3, IL1RL1, ENTPD1, BBS4, CELSR2, F11R, RAPGEF3, HYAL1, ZNF259, ATOX1, ATF6, KHK, SAT1, GGH, TIMP4, SLC4A4, PDE2A, PDE3B, FADS1, FADS2, TMSB4X, TXNIP, LIMS1, RHOB, LY96, FOXO1, PNPLA2,TRH, GJC1, S:C17A5, FTO, GJD2, PRSC1, CASP12, GPBAR1, PXK, IL33, TRIB1, PBX4, NUPR1, 15-SEP, CILP2, TERC, GGT2, MTCO1, UOX, AVP |
| Cataract | eye | | CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQP0, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1 |

TABLE A-continued

Exemplary Genetic and Other Diseases and Associated Genes

| Disease Name | Primary Tissues or System Affected | Additional Tissues/ Systems Affected | Genes |
|---|---|---|---|
| CDKL-5 Deficiencies or Mediated Diseases | Brain, CNS | | CDKL5 |
| Charcot-Marie-Tooth (CMT) disease (Types 1, 2, 3, 4,) | Nervous system | Muscles (dystrophy) | PMP22 (CMT1A and E), MPZ (CMT1B), LITAF (CMT1C), EGR2 (CMT1D), NEFL (CMT1F), GJB1 (CMT1X), MFN2 (CMT2A), KIF1B (CMT2A2B), RAB7A (CMT2B), TRPV4 (CMT2C), GARS (CMT2D), NEFL (CMT2E), GAPD1 (CMT2K), HSPB8 (CMT2L), DYNC1H1, CMT20), LRSAM1 (CMT2P), IGHMBP2 (CMT2S), MORC2 (CMT2Z), GDAP1 (CMT4A), MTMR2 or SBF2/MTMR13 (CMT4B), SH3TC2 (CMT4C), NDRG1 (CMT4D), PRX (CMT4F), FIG4 (CMT4J), NT-3 |
| Chédiak-Higashi Syndrome | Immune system | Skin, hair, eyes, neurons | LYST |
| Choroidermia | | | CHM, REP1, |
| Chorioretinal atrophy | eye | | PRDM13, RGR, TEAD1 |
| Chronic Granulomatous Disease | Immune system | | CYBA, CYBB, NCF1, NCF2, NCF4 |
| Chronic Mucocutaneous Candidiasis | Immune system | | AIRE, CARD9, CLEC7A IL12B, IL12B1, IL1F, IL17RA, IL17RC, RORC, STAT1, STAT3, TRAF31P2 |
| Cirrhosis | liver | | KRT18, KRT8, CIRH1A, NAIC, TEX292, KIAA1988 |
| Colon cancer (Familial adenomatous polyposis (FAP) and hereditary nonpolyposis colon cancer (HNPCC)) | Gastrointestinal | | FAP: APC HNPCC: MSH2, MLH1, PMS2, SH6, PMS1 |
| Combined Immunodeficiency | Immune System | | IL2RG, SCIDX1, SCIDX, IMD4); HIV-1 (CCL5, SCYA5, D17S136E, TCP228 |
| Cone(-rod) dystrophy | eye | | AIPL1, CRX, GUA1A, GUCY2D, PITPM3, PROM1, PRPH2, RIMS1, SEMA4A, ABCA4, ADAM9, ATF6, C21ORF2, C8ORF37, CACNA2D4, CDHR1, CERKL, CNGA3, CNGB3, CNNM4, CNAT2, IFT81, KCNV2, PDE6C, PDE6H, POC1B, RAX2, RDH5, RPGRIP1, TTLL5, RetCG1, GUCY2E |
| Congenital Stationary Night Blindness | eye | | CABP4, CACNA1F, CACNA2D4, CPR179, GRK1, GRM6, GNAT1, LRIT3, NYX, PDE6B, RDH5, RHO, RLBP1, RPE65, SAG, SLC24A1, TRPM1, |
| Congenital Fructose Intolerance | Metabolism | | ALDOB |
| Cori's Disease (Glycogen Storage Disease Type III) | Various- wherever glycogen accumulates, particularly liver, heart, skeletal muscle | | AGL |
| Corneal clouding and dystrophy | eye | | APOA1, TGFBI, CSD2, CDGG1, CSD, BIGH3, CDG2, TACSTD2, TROP2, M1S1, VSX1, RINX, PPCD, PPD, KTCN, COL8A2, FECD, PPCD2, PIP5K3, CFD |
| Cornea plana congenital | | | KERA, CNA2 |
| Cri du chat Syndrome, also known as 5p syndrome and cat cry syndrome | | | Deletions involving only band 5p15.2 to the entire short arm of chromosome 5, e.g. CTNND2, TERT, |
| Cystic Fibrosis (CF) | Lungs and respiratory system | Pancreas, liver, digestive system, reproductive system, exocrine, glands, | CTFR, ABCC7, CF, MRP7, SCNN1A, those described in WO2015157070 |

TABLE A-continued

Exemplary Genetic and Other Diseases and Associated Genes

| Disease Name | Primary Tissues or System Affected | Additional Tissues/ Systems Affected | Genes |
|---|---|---|---|
| Diabetic nephropathy | kidney | | Gremlin, 12/15- lipoxygenase, TIM44, |
| Dent Disease (Types 1 and 2) | Kidney | | Type 1: CLCN5, Type 2: ORCL |
| Dentatorubro-Pallidoluysian Atrophy (DRPLA) (aka Haw River and Naito-Oyanagi Disease) | CNS, brain, muscle | | Atrophin-1 and Atn1 |
| Down Syndrome | various | | Chromosome 21 trisomy |
| Drug Addiction | Brain | | Prkce; Drd2; Drd4; ABAT; GRIA2; Grm5; Grin1; Htr1b; Grin2a; Drd3; Pdyn; Gria1 |
| Duane syndrome (Types 1, 2, and 3, including subgroups A, B and C). Other names for this condition include: Duane's Retraction Syndrome (or DR syndrome), Eye Retraction Syndrome, Retraction Syndrome, Congenital retraction syndrome and Stilling-Turk-Duane Syndrome | eye | | CHN1, indels on chromosomes 4 and 8 |
| Duchenne muscular dystrophy (DMD) | muscle | Cardiovascular, respiratory | DMD, BMD, dystrophin gene, intron flanking exon 51 of DMD gene, exon 51 mutations in DMD gene, see also WO2013163628 and US Pat. Pub. 20130145487 |
| Edward's Syndrome (Trisomy 18) | | | Complete or partial trisomy of chromosome 18 |
| Ehlers-Danlos Syndrome (Types I-VI) | Various depending on type: including musculoskeletal, eye, vasculature, immune, and skin | | COL5A1, COL5A2, COL1A1, COL3A1, TNXB, PLOD1, COL1A2, FKBP14 and ADAMTS2 |
| Emery-Dreifuss muscular dystrophy | muscle | | LMNA, LMN1, EMD2, FPLD, CMD1A, HGPS, LGMD1B, LMNA, LMN1, EMD2, FPLD, CMD1A |
| Enhanced S-Cone Syndrome | eye | | NR2E3, NRL |
| Fabry's Disease | Various - including skin, eyes, and gastrointestinal system, kidney, heart, brain, nervous system | | GLA |
| Facioscapulohumeral muscular dystrophy | muscles | | FSHMD1A, FSHD1A, FRG1, |
| Factor H and Factor H-like 1 | blood | | HF1, CFH, HUS |
| Factor V Leiden thrombophilia and Factor V deficiency | blood | | Factor V (F5) |
| Factor V and Factor VII deficiency | blood | | MCFD2 |
| Factor VII deficiency | blood | | F7 |
| Factor X deficiency | blood | | F10 |
| Factor XI deficiency | blood | | F11 |
| Factor XII deficiency | blood | | F12, HAF |
| Factor XIIIA deficiency | blood | | F13A1, F13A |
| Factor XIIIB deficiency | blood | | F13B |
| Familial Hypercholestereolemia | Cardiovascular system | | APOB, LDLR, PCSK9 |
| Familial Mediterranean Fever (FMF) also called recurrent polyserositis or familial paroxysmal polyserositis | Various- organs/tissues with serous or synovial membranes, skin, joints | Heart, kidney, brain/CNS, reproductive organs | MEFV |

TABLE A-continued

Exemplary Genetic and Other Diseases and Associated Genes

| Disease Name | Primary Tissues or System Affected | Additional Tissues/ Systems Affected | Genes |
|---|---|---|---|
| Fanconi Anemia | Various - blood (anemia), immune system, cognitive, kidneys, eyes, musculoskeletal | | FANCA, FACA, FA1, FA, FAA, FAAP95, FAAP90, FLJ34064, FANCC, FANCG, RAD51, BRCA1, BRCA2, BRIP1, BACH1, FANCJ, FANCB, FANCD1, FANCD2, FANCD, FAD, FANCE, FACE, FANCF, FANCI, ERCC4, FANCL, FANCM, PALB2, RAD51C, SLX4, UBE2T, FANCB, XRCC9, PHF9, KIAA1596 |
| Fanconi Syndrome Types I (Childhood onset) and II (Adult Onset) | kidneys | | FRTS1, GATM |
| Fragile X syndrome and related disorders | brain | | FMR1, FMR2; FXR1; FXR2; mGLUR5 |
| Fragile XE Mental Retardation (aka Martin Bell syndrome) | Brain, nervous system | | FMR1 |
| Friedreich Ataxia (FRDA) | Brain, nervous system | heart | FXN/X25 |
| Fuchs endothelial corneal dystrophy | Eye | | TCF4; COL8A2 |
| Galactosemia | Carbohydrate metabolism disorder | Various-where galactose accumulates - liver, brain, eyes | GALT, GALK1, and GALE |
| Gastrointestinal Epithelial Cancer, GI cancer | | | CISH |
| Gaucher Disease (Types 1, 2, and 3, as well as other unusual forms that may not fit into these types) | Fat metabolism disorder | Various-liver, spleen, blood, CNS, skeletal system | GBA |
| Griscelli syndrome | | | |
| Glaucoma | eye | | MYOC, TIGR, GLC1A, JOAG, GPOA, OPTN, GLC1E, FIP2, HYPL, NRP, CYP1B1, GLC3A, OPA1, NTG, NPG, CYP1B1, GLC3A, those described in WO2015153780 |
| Glomerulo sclerosis | kidney | | CC chemokine ligand 2 |
| Glycogen Storage Diseases Types I-VI -See also Cori's Disease, Pompe's Disease, McArdle's disease, Hers Disease, and Von Gierke's disease | Metabolism Diseases | | SLC2A2, GLUT2, G6PC, G6PT, G6PT1, GAA, LAMP2, LAMPB, AGL, GDE, GBE1, GYS2, PYGL, PFKM, see also Cori's Disease, Pompe's Disease, McArdle's disease, Hers Disease, and Von Gierke's disease |
| RBC Glycolytic enzyme deficiency | blood | | any mutations in a gene for an enzyme in the glycolysis pathway including mutations in genes for hexokinases I and II, glucokinase, phosphoglucose isomerase, phosphofructokinase, aldolase Bm triosephosphate isomerease, glyceraldehydee-3-phosphate dehydrogenase, phosphoglycerokinase, phosphoglycerate mutase, enolase I, pyruvate kinase |
| Hartnup's disease | Malabsorption disease | Various- brain, gastrointestinal, skin, | SLC6A19 |
| Hearing Loss | ear | | NOX3, Hes5, BDNF, |
| Hemochromatosis (HH) | Iron absorption regulation disease | Various- wherever iron accumulates, liver, heart, pancreas, joints, pituitary gland | HFE and H63D |
| Hemophagocytic lymphohistiocytosis disorders | blood | | PRF1, HPLH2, UNC13D, MUNC13-4, HPLH3, HLH3, FHL3 |
| Hemorrhagic disorders | blood | | PI, ATT, F5 |
| Hers disease (Glycogen storage disease Type VI) | liver | muscle | PYGL |

TABLE A-continued

Exemplary Genetic and Other Diseases and Associated Genes

| Disease Name | Primary Tissues or System Affected | Additional Tissues/ Systems Affected | Genes |
|---|---|---|---|
| Hereditary angioedema (HAE) | | | kalikrein B1 |
| Hereditary Hemorrhagic Telangiectasia (Osler-Weber-Rendu Syndrome) | Skin and mucous membranes | | ACVRL1, ENG and SMAD4 |
| Hereditary Spherocytosis | blood | | NK1, EPB42, SLC4A1, SPTA1, and SPTB |
| Hereditary Persistence of Fetal Hemoglobin | blood | | HBG1, HBG2, BCL11A, promoter region of HBG 1 and/or 2 (in the CCAAT box) |
| Hemophilia (hemophilia A (Classic) a B (aka Christmas disease) and C) | blood | | A: FVIII, F8C, HEMA B: FVIX, HEMB, FIX C: F9, F11 |
| Hepatic adenoma | liver | | TCF1, HNF1A, MODY3 |
| Hepatic failure, early onset, and neurologic disorder | liver | | SCOD1, SCO1 |
| Hepatic lipase deficiency | liver | | LIPC |
| Hepatoblastoma, cancer and carcinomas | liver | | CTNNB1, PDGFRL, PDGRL, PRLTS, AXIN1, AXIN, CTNNB1, TP53, P53, LFS1, IGF2R, MPRI, MET, CASP8, MCH5 |
| Hermansky-Pudlak syndrome | Skin, eyes, blood, lung, kidneys, intestine | | HPS1, HPS3, HPS4, HPS5, HPS6, HPS7, DTNBP1, BLOC1, BLOC1S2, BLOC3 |
| HIV susceptibility or infection | Immune system | | IL10, CSIF, CMKBR2, CCR2, CMKBR5, CCCKR5 (CCR5), those in WO2015148670A1 |
| Holoprosencephaly (HPE) (Alobar, Semilobar, and Lobar) | brain | | ACVRL1, ENG, SMAD4 |
| Homocystinuria | Metabolic disease | Various- connective tissue, muscles, CNS, cardiovascular system | CBS, MTHFR, MTR, MTRR, and MMADHC |
| HPV | | | HPV16 and HPV18 E6/E7 |
| HSV1, HSV2, and related keratitis | eye | | HSV1 genes (immediate early and late HSV-1 genes (UL1, 1.5, 5, 6, 8, 9, 12, 15, 16, 18, 19, 22, 23, 26, 26.5, 27, 28, 29, 30, 31, 32, 33, 34, 35, 36, 37, 38, 42, 48, 49.5, 50, 52, 54, S6, RL2, RS1, those described in WO2015153789, WO2015153791 |
| Hunter's Syndrome (aka Mucopolysaccharidosis type II) | Lysosomal storage disease | Various- liver, spleen, eye, joint, heart, brain, skeletal | IDS |
| Huntington's disease (HD) and HD-like disorders | Brain, nervous system | | HD, HTT, IT15, PRNP, PRIP, JPH3, JP3, HDL2, TBP, SCA17, PRKCE; IGF1; EP300; RCOR1; PRKCZ; HDAC4; and TGM2, and those described in WO2013130824, WO2015089354 |
| Hurler's Syndrome (aka mucopolysaccharidosis type I H, MPS IH) | Lysosomal storage disease | Various- liver, spleen, eye, joint, heart, brain, skeletal | IDUA, α-L-iduronidase |
| Hurler-Scheie syndrome (aka mucopolysaccharidosis type I H-S, MPS I H-S) | Lysosomal storage disease | Various- liver, spleen, eye, joint, heart, brain, skeletal | IDUA, α-L-iduronidase |
| hyaluronidase deficiency (aka MPS IX) | Soft and connective tissues | | HYAL1 |
| Hyper IgM syndrome | Immune system | | CD40L |
| Hyper- tension caused renal damage | kidney | | Mineral corticoid receptor |
| Immunodeficiencies | Immune System | | CD3E, CD3G, AICDA, AID, HIGM2, TNFRSF5, CD40, UNG, DGU, HIGM4, TNFSF5, CD40LG, HIGM1, IGM, FOXP3, IPEX, AIID, XPID, PIDX, TNFRSF14B, TACI |

TABLE A-continued

Exemplary Genetic and Other Diseases and Associated Genes

| Disease Name | Primary Tissues or System Affected | Additional Tissues/ Systems Affected | Genes |
|---|---|---|---|
| Inborn errors of metabolism: including urea cycle disorders, organic acidemias), fatty acid oxidation defects, amino acidopathies, carbohydrate disorders, mitochondrial disorders | Metabolism diseases, liver | Various organs and cells | See also: Carbohydrate metabolism disorders (e.g. galactosemia), Amino acid Metabolism disorders (e.g. phenylketonuria), Fatty acid metabolism (e.g. MCAD deficiency), Urea Cycle disorders (e.g. Citrullinemia), Organic acidemias (e.g. Maple Syrup Urine disease), Mitochondrial disorders (e.g. MELAS), peroxisomal disorders (e.g. Zellweger syndrome) |
| Inflammation | Various | | IL-10; IL-1 (IL-1a; IL-1b); IL-13; IL-17 (IL-17a (CTLA8); IL-17b; IL-17c; IL-17d; IL-17f); Il-23; Cx3cr1; ptpn22; TNFa; NOD2/CARD15 for IBD; IL-6; IL-12 (IL-12a; IL-12b); CTLA4; Cx3cl1 |
| Inflammatory Bowel Diseases (e.g. Ulcerative Colitis and Chron's Disease) | Gastrointestinal | Joints, skin | NOD2, IRGM, LRRK2, ATG5, ATG16L1, IRGM, GATM, ECM1, CDH1, LAMB1, HNF4A, GNA12, IL10, CARD9/15. CCR6, IL2RA, MST1, TNFSF15, REL, STAT3, IL23R, IL12B, FUT2 |
| Interstitial renal fibrosis | kidney | | TGF-β type II receptor |
| Job's Syndrome (aka Hyper IgE Syndrome) | Immune System | | STAT3, DOCK8 |
| Juvenile Retinoschisis | eye | | RS1, XLRS1 |
| Kabuki Syndrome 1 | | | MLL4, KMT2D |
| Kennedy Disease (aka Spinobulbar Muscular Atrophy) | Muscles, brain, nervous system | | SBMA/SMAX1/AR |
| Klinefelter syndrome | Various- particularly those involved in development of male characteristics | | Extra X chromosome in males |
| Lafora Disease | Brain, CNS | | EMP2A and EMP2B |
| Leber Congenital Amaurosis | eye | | CRB1, RP12, CORD2, CRD, CRX, IMPDH1, OTX2, AIPL1, CABP4, CCT2, CEP290, CLUAP1, CRB1, CRX, DTHD1, GDF6, GUCY2D, IFT140, IQCB1, KCNJ13, LCA5, LRAT, NMNAT1, PRPH2, RD3, RDH12, RPE65, RP20, RPGRIP1, SPATA7, TULP1, LCA1, LCA4, GUC2D, CORD6, LCA3, |
| Lesch-Nyhan Syndrome | Metabolism disease | Various - joints, cognitive, brain, nervous system | HPRT1 |
| Leukocyte deficiencies and disorders | blood | | ITGB2, CD18, LCAMB, LAD, EIF2B1, EIF2BA, EIF2B2, EIF2B3, EIF2B5, LVWM, CACH, CLE, EIF2B4 |
| Leukemia | Blood | | TAL1, TCL5, SCL, TAL2, FLT3, NBS1, NBS, ZNFN1A1, IK1, LYF1, HOXD4, HOX4B, BCR, CML, PHL, ALL, ARNT, KRAS2, RASK2, GMPS, AF10, ARHGEF12, LARG, KIAA0382, CALM, CLTH, CEBPA, CEBP, CHIC2, BTL, FLT3, KIT, PBT, LPP, NPM1, NUP214, D9S46E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, |

TABLE A-continued

Exemplary Genetic and Other Diseases and Associated Genes

| Disease Name | Primary Tissues or System Affected | Additional Tissues/ Systems Affected | Genes |
|---|---|---|---|
| | | | NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9S46E, CAN, CAIN |
| Limb-girdle muscular dystrophy diseases | muscle | | LGMD |
| Lowe syndrome | brain, eyes, kidneys | | OCRL |
| Lupus glomerulo- nephritis | kidney | | MAPK1 |
| Machado-Joseph's Disease (also known as Spinocerebellar ataxia Type 3) | Brain, CNS, muscle | | ATX3 |
| Macular degeneration | eye | | ABC4, CBC1, CHM1, APOE, C1QTNF5, C2, C3, CCL2, CCR2, CD36, CFB, CFH, CFHR1, CFHR3, CNGB3, CP, CRP, CST3, CTSD, CX3CR1, ELOVL4, ERCC6, FBLN5, FBLN6, FSCN2, HMCN1, HIRAI, IL6, IL8, PLEKHA1, PROM1, PRPH2, RPGR, SERPING1, TCOF1, TIMP3, TLR3 |
| Macular Dystrophy | eye | | BEST1, C1QTNF5, CTNNA1, EFEMP1, ELOVL4, FSCN2, GUCA1B, HMCN1, IMPG1, OTX2, PRDM13, PROM1, PRPH2, RP1L1, TIMP3, ABCA4, CFH, DRAM2, IMG1, MFSD8, ADMD, STGD2, STGD3, RDS, RP7, PRPH, AVMD, AOFMD, VMD2 |
| Malattia Leventinesse | eye | | EFEMP1, FBLN3 |
| Maple Syrup Urine Disease | Metabolism disease | | BCKDHA, BCKDHB, and DBT |
| Marfan syndrome | Connective tissue | Musculoskeletal | FBN1 |
| Maroteaux-Lamy Syndrome (aka MPS VI) | Musculoskeletal system, nervous system | Liver, spleen | ARSB |
| McArdle's Disease (Glycogen Storage Disease Type V) | Glycogen storage disease | muscle | PYGM |
| Medullary cystic kidney disease | kidney | | UMOD, HNFJ, FJHN, MCKD2, ADMCKD2 |
| Metachromatic leukodystrophy | Lysosomal storage disease | Nervous system | ARSA |
| Methylmalonic acidemia (MMA) | Metabolism disease | | MMAA, MMAB, MUT, MMACHC, MMADHC, LMBRD1 |
| Morquio Syndrome (aka MPS IV A and B) | Connective tissue, skin, bone, eyes | heart | GALNS |
| Mucopolysaccharidosis diseases (Types I H/S, I H, II, III A B and C, I S, IVA and B, IX, VII, and VI) | Lysosomal storage disease - affects various organs/tissues | | See also Hurler/Scheie syndrome, Hurler disease, Sanfillipo syndrome, Scheie syndrome, Morquio syndrome, hyaluronidase deficiency, Sly syndrome, and Maroteaux-Lamy syndrome |
| Muscular Atrophy | muscle | | VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1 |
| Muscular dystrophy | muscle | | FKRP, MDC1C, LGMD2I, LAMA2, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1 |

TABLE A-continued

Exemplary Genetic and Other Diseases and Associated Genes

| Disease Name | Primary Tissues or System Affected | Additional Tissues/ Systems Affected | Genes |
| --- | --- | --- | --- |
| Myotonic dystrophy (Type 1 and Type 2) | Muscles | Eyes, heart, endocrine | CNBP (Type 2) and DMPK (Type 1) |
| Neoplasia | | | PTEN; ATM; ATR; EGFR; ERBB2; ERBB3; ERBB4; Notch1; Notch2; Notch3; Notch4; AKT; AKT2; AKT3; HIF; HIF1a; HIF3a; Met; HRG; Bcl2; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bcl2; caspases family (9 members: 1, 2, 3, 4, 6, 7, 8, 9, 12); Kras; Apc |
| Neurofibromatosis (NF) (NF1, formerly Recklinghausen's NF, and NF2) | brain, spinal cord, nerves, and skin | | NF1, NF2 |
| Niemann-Pick Lipidosis (Types A, B, and C) | Lysosomal Storage Disease | Various- where sphingomyelin accumulates, particularly spleen, liver, blood, CNS | Types A and B: SMPD1; Type C: NPC1 or NPC2 |
| Noonan Syndrome | Various - musculoskeletal, heart, eyes, reproductive organs, blood | | PTPN11, SOS1, RAF1 and KRAS |
| Norrie Disease or X-linked Familial Exudative Vitreoretinopathy | eye | | NDP |
| North Carolina Macular Dystrophy | eye | | MCDR1 |
| Osteogenesis imperfecta (OI) (Types I, II, III, IV, V, VI, VII) | bones, musculoskeletal | | COL1A1, COL1A2, CRTAP, P3H |
| Osteopetrosis | bones | | LRP5, BMND1, LRP7, LR3, OPPG, VBCH2, CLCN7, CLC7, OPTA2, OSTM1, GL, TCIRG1, TIRC7, OC116, OPTB1 |
| Patau's Syndrome (Trisomy 13) | Brain, heart, skeletal system | | Additional copy of chromosome 13 |
| Parkinson's disease (PD) | Brain, nervous system | | SNCA (PARK1), UCHL1 (PARK 5), and LRRK2 (PARK8), (PARK3), PARK2, PARK4, PARK7 (PARK7), PINK1 (PARK6); x-Synuclein, DJ-1, Parkin, NR4A2, NURR1, NOT, TINUR, SNCAIP, TBP, SCA17, NCAP, PRKN, PDJ, DBH, NDUFV2 |
| Pattern Dystrophy of the RPE | eye | | RDS/peripherin |
| Phenylketonuria (PKU) | Metabolism disorder | Various due to build-up of phenylalanine, phenyl ketones in tissues and CNS | PAH, PKU1, QDPR, DHPR, PTS |
| Polycystic kidney and hepatic disease | Kidney, liver | | FCYT, PKHD1, ARPKD, PKD1, PKD2, PKD4, PKDTS, PRKCSH, G19P1, PCLD, SEC63 |
| Pompe's Disease | Glycogen storage disease | Various - heart, liver, spleen | GAA |
| Porphyria (actually refers to a group of different diseases all having a specific heme production process abnormality) | Various- wherever heme precursors accumulate | | ALAD, ALAS2, CPOX, FECH, HMBS, PPOX, UROD, or UROS |
| posterior polymorphous corneal dystrophy | eyes | | TCF4; COL8A2 |

TABLE A-continued

Exemplary Genetic and Other Diseases and Associated Genes

| Disease Name | Primary Tissues or System Affected | Additional Tissues/ Systems Affected | Genes |
|---|---|---|---|
| Primary Hyperoxaluria (e.g. type 1) | Various - eyes, heart, kidneys, skeletal system | | LDHA (lactate dehydrogenase A) and hydroxyacid oxidase 1 (HAO1) |
| Primary Open Angle Glaucoma (POAG) | eyes | | MYOC |
| Primary sclerosing cholangitis | Liver, gallbladder | | TCF4; COL8A2 |
| Progeria (also called Hutchinson-Gilford progeria syndrome) | All | | LMNA |
| Prader-Willi Syndrome | Musculoskeletal system, brain, reproductive and endocrine system | | Deletion of region of short arm of chromosome 15, including UBE3A |
| Prostate Cancer | prostate | | HOXB13, MSMB, GPRC6A, TP53 |
| Pyruvate Dehydrogenase Deficiency | Brain, nervous system | | PDHA1 |
| Kidney/Renal carcinoma | kidney | | RLIP76, VEGF |
| Rett Syndrome | Brain | | MECP2, RTT, PPMX, MRX16, MRX79, CDKL5, STK9, MECP2, RTT, PPMX, MRX16, MRX79, x-Synuclein, DJ-1 |
| Retinitis pigmentosa (RP) | eye | | ADIPOR1, ABCA4, AGBL5, ARHGEF18, ARL2BP, ARL3, ARL6, BEST1, BBS1, BBS2, C2ORF71, C8ORF37, CA4, CERKL, CLRN1, CNGA1, CMGB1, CRB1, CRX, CYP4V2, DHDDS, DHX38, EMC1, EYS, FAM161A, FSCN2, GPR125, GUCA1B, HK1, HPRPF3, HGSNAT, IDH3B, IMPDH1, IMPG2, IFT140, IFT172, KLHL7, KIAA1549, KIZ, LRAT, MAK, MERTK, MVK, NEK2, NUROD1, NR2E3, NRL, OFD1, PDE6A, PDE6B, PDE6G, POMGNT1, PRCD, PROM1, PRPF3, PRPF4, PRPF6, PRPF8, PRPF31, PRPH2, RPB3, RDH12, REEP6, RP39, RGR, RHO, RLBP1, ROM1, RP1, RP1L1, RPY, RP2, RP9, RPE65, RPGR, SAMD11, SAG, SEMA4A, SLC7A14, SNRNP200, SPP2, SPATA7, TRNT1, TOPORS, TTC8, TULP1, USH2A, ZFN408, ZNF513, see also 20120204282 |
| Scheie syndrome (also known as mucopolysaccharidosis type I S(MPS I-S)) | Various- liver, spleen, eye, joint, heart, brain, skeletal | | IDUA, α-L-iduronidase |
| Schizophrenia | Brain | | Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b; 5-HTT (Slc6a4); COMT; DRD (Drd1a); SLC6A3; DAOA; DTNBP1; Dao (Dao1); TCF4; COL8A2 |
| Secretase Related Disorders | Various | | APH-1 (alpha and beta); PSEN1; NCSTN; PEN-2; Nos1, Parp1, Nat1, Nat2, CTSB, APP, APH1B, PSEN2, PSENEN, BACE1, ITM2B, CTSD, NOTCH1, TNF, INS, DYT10, ADAM17, APOE, ACE, STN, TP53, IL6, NGFR, IL1B, ACHE, CTNNB1, IGF1, IFNG, NRG1, CASP3, MAPK1, CDH1, APBB1, HMGCR, CREB1, PTGS2, HES1, CAT, TGFB1, ENO2, ERBB4, TRAPPC10, MAOB, NGF, MMP12, JAG1, CD40LG, PPARG, FGF2, LRP1, NOTCH4, MAPK8, PREP, NOTCH3, PRNP, CTSG, EGF, |

TABLE A-continued

Exemplary Genetic and Other Diseases and Associated Genes

| Disease Name | Primary Tissues or System Affected | Additional Tissues/ Systems Affected | Genes |
|---|---|---|---|
| | | | REN, CD44, SELP, GHR, ADCYAP1, INSR, GFAP, MMP3, MAPK10, SP1, MYC, CTSE, PPARA, JUN, TIMP1, IL5, IL1A, MMP9, HTR4, HSPG2, KRAS, CYCS, SMG1, IL1R1, PROK1, MAPK3, NTRK1, IL13, MME, TKT, CXCR2, CHRM1, ATXN1, PAWR, NOTCJ2, M6PR, CYP46A1, CSNK1D, MAPK14, PRG2, PRKCA, L1 CAM, CD40, NR1I2, JAG2, CTNND1, CMA1, SORT1, DLK1, THEM4, JUP, CD46, CCL11, CAV3, RNASE3, HSPA8, CASP9, CYP3A4, CCR3, TFAP2A, SCP2, CDK4, JOF1A, TCF7L2, B3GALTL, MDM2, RELA, CASP7, IDE, FANP4, CASK, ADCYAP1R1, ATF4, PDGFA, C21ORF33, SCG5, RMF123, NKFB1, ERBB2, CAV1, MMP7, TGFA, RXRA, STX1A, PSMC4, P2RY2, TNFRSF21, DLG1, NUMBL, SPN, PLSCR1, UBQLN2, UBQLN1, PCSK7, SPON1, SILV, QPCT, HESS, GCC1 |
| Selective IgA Deficiency | Immune system | | Type 1: MSH5; Type 2: TNFRSF13B |
| Severe Combined Immunodeficiency (SCID) and SCID-χI, and ADA-SCID | Immune system | | JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4, those identified in US Pat. App. Pub. 20110225664, 20110091441, 20100229252, 20090271881 and 20090222937; |
| Sickle cell disease | blood | | HBB, BCL11A, BCL11Ae, cis-regulatory elements of the B-globin locus, HBG ½ promoter, HBG distal CCAAT box region between −92 and −130 of the HBG Transcription Start Site, those described in WO2015148863, WO 2013/126794, US Pat. Pub. 20110182867 |
| Sly Syndrome (aka MPS VII) | | | GUSB |
| Spinocerebellar Ataxias (SCA types 1, 2, 3, 6, 7, 8, 12 and 17) | | | ATXN1, ATXN2, ATX3 |
| Sorsby Fundus Dystrophy | eye | | TIMP3 |
| Stargardt disease | eye | | ABCR, ELOVL4, ABCA4, PROM1 |
| Tay-Sachs Disease | Lysosomal Storage disease | Various - CNS, brain, eye | HEX-A |
| Thalassemia (Alpha, Beta, Delta) | blood | | HBA1, HBA2 (Alpha), HBB (Beta), HBB and HBD (delta), LCRB, BCL11A, BCL11Ae, cis-regulatory elements of the B-globin locus, HBG ½ promoter, those described in WO2015148860, US Pat. Pub. 20110182867, 2015/148860 |
| Thymic Aplasia (DiGeorge Syndrome; 22q11.2 deletion syndrome) | Immune system, thymus | | deletion of 30 to 40 genes in the middle of chromosome 22 at a location known as 22q11.2, including TBX1, DGCR8 |
| Transthyretin amyloidosis (ATTR) | liver | | TTR (transthyretin) |
| trimethylaminuria | Metabolism disease | | FMO3 |
| Trinucleotide Repeat Disorders (generally) | Various | | HTT; SBMA/SMAX1/AR; FXN/X25 ATX3; ATXN1; ATXN2; DMPK; Atrophin-1 and Atn1 (DRPLA Dx); CBP (Creb-BP - global instability); VLDLR; Atxn7; Atxn10; FEN1, TNRC6A, PABPN1, JPH3, MED15, ATXN1, ATXN3, TBP, CACNA1A, ATXN80S, PPP2R2B, ATXN7, TNRC6B, TNRC6C, CELF3, |

TABLE A-continued

Exemplary Genetic and Other Diseases and Associated Genes

| Disease Name | Primary Tissues or System Affected | Additional Tissues/ Systems Affected | Genes |
|---|---|---|---|
| | | | MAB21L1, MSH2, TMEM185A, SIX5, CNPY3, RAXE, GNB2, RPL14, ATXN8, ISR, TTR, EP400, GIGYF2, OGG1, STC1, CNDP1, C10ORF2, MAML3, DKC1, PAXIP1, CASK, MAPT, SP1, POLG, AFF2, THBS1, TP53, ESR1, CGGBP1, ABT1, KLK3, PRNP, JUN, KCNN3, BAX, FRAXA, KBTBD10, MBNL1, RAD51, NCOA3, ERDA1, TSC1, COMP, GGLC, RRAD, MSH3, DRD2, CD44, CTCF, CCND1, CLSPN, MEF2A, PTPRU, GAPDH, TRIM22, WT1, AHR, GPX1, TPMT, NDP, ARX, TYR, EGR1, UNG, NUMBL, FABP2, EN2, CRYGC, SRP14, CRYGB, PDCD1, HOXA1, ATXN2L, PMS2, GLA, CBL, FTH1, IL12RB2, OTX2, HOXA5, POLG2, DLX2, AHRR, MANF, RMEM158, see also 20110016540 |
| Turner's Syndrome (XO) | Various - reproductive organs, and sex characteristics, vasculature | | Monosomy X |
| Tuberous Sclerosis | CNS, heart, kidneys | | TSC1, TSC2 |
| Usher syndrome (Types I, II, and III) | Ears, eyes | | ABHD12, CDH23, CIB2, CLRN1, DFNB31, GPR98, HARS, MYO7A, PCDH15, USH1C, USH1G, USH2A, USH11A, those described in WO2015134812A1 |
| Velocardiofacial syndrome (aka 22q11.2 deletion syndrome, DiGeorge syndrome, conotruncal anomaly face syndrome (CTAF), autosomal dominant Opitz G/BB syndrome or Cayler cardiofacial syndrome) | Various - skeletal, heart, kidney, immune system, brain | | Many genes are deleted, COM, TBX1, and other are associated with symptoms |
| Von Gierke's Disease (Glycogen Storage Disease type I) | Glycogen Storage disease | Various - liver, kidney | G6PC and SLC37A4 |
| Von Hippel-Lindau Syndrome | Various - cell growth regulation disorder | CNS, Kidney, Eye, visceral organs | VHL |
| Von Willebrand Disease (Types I, II and III) | blood | | VWF |
| Wilson Disease | Various - Copper Storage Disease | Liver, brains, eyes, other tissues where copper builds up | ATP7B |
| Wiskott-Aldrich Syndrome | Immune System | | WAS |
| Xeroderma Pigmentosum | Skin | Nervous system | POLH |
| XXX Syndrome | Endocrine, brain | | X chromosome trisomy |

TABLE B

Exemplary Genes controlling Cellular Functions

| CELLULAR FUNCTION | GENES |
|---|---|
| PI3K/AKT Signaling | PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB; DYRK1A; CDKN1A; ITGB1; MAP2K2; JAK1; AKT1; JAK2; PIK3R1; |

TABLE B-continued

Exemplary Genes controlling Cellular Functions

| CELLULAR FUNCTION | GENES |
|---|---|
| | CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1 |
| ERK/MAPK Signaling | PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK |
| Glucocorticoid Receptor Signaling | RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP1; STAT1; IL6; HSP90AA1 |
| Axonal Guidance Signaling | PRKCE; ITGAM; ROCK1; ITGA5; CXCR4; ADAM12; IGF1; RAC1; RAP1A; EIF4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA |
| Ephrin Receptor Signaling | PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK |
| Actin Cytoskeleton Signaling | ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK |
| Huntington's Disease Signaling | PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKCI; HSPA5; REST; GNAQ; PIK3CB; PIK3C3; MAPK8; IGF1R; PRKD1; GNB2L1; BCL2L1; CAPN1; MAPK3; CASP8; HDAC2; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3 |
| Apoptosis Signaling | PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; |

TABLE B-continued

Exemplary Genes controlling Cellular Functions

| CELLULAR FUNCTION | GENES |
|---|---|
| | CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1 |
| B Cell Receptor Signaling | RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1 |
| Leukocyte Extravasation Signaling | ACTN4; CD44; PRKCE; ITGAM; ROCK1; CXCR4; CYBA; RAC1; RAP1A; PRKCZ; ROCK2; RAC2; PTPN11; MMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; F11R; ITK; CRKL; VAV3; CTTN; PRKCA; MMP1; MMP9 |
| Integrin Signaling | ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3 |
| Acute Phase Response Signaling | IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6 |
| PTEN Signaling | ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1 |
| p53 Signaling | PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS1; ATR; BCL2L1; E2F1; PMAIP1; CHEK2; TNFRSF10B; TP73; RB1; HDAC9; CDK2; PIK3C2A; MAPK14; TP53; LRDD; CDKN1A; HIPK2; AKT1; PIK3R1; RRM2B; APAF1; CTNNB1; SIRT1; CCND1; PRKDC; ATM; SFN; CDKN2A; JUN; SNAI2; GSK3B; BAX; AKT3 |
| Aryl Hydrocarbon Receptor Signaling | HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F1; MAPK3; NRIP1; CHEK2; RELA; TP73; GSTP1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1 |
| Xenobiotic Metabolism Signaling | PRKCE; EP300; PRKCZ; RXRA; MAPK1; NQO1; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1 |
| SAPK/JNK Signaling | PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK |

TABLE B-continued

| Exemplary Genes controlling Cellular Functions | |
|---|---|
| CELLULAR FUNCTION | GENES |
| PPAr/RXR Signaling | PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP90AA1; ADIPOQ |
| NF-KB Signaling | IRAK1; EIF2AK2; EP300; INS; MYD88; PRKCZ; TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1 |
| Neuregulin Signaling | ERBB4; PRKCE; ITGAM; ITGA5; PTEN; PRKCZ; ELK1; MAPK1; PTPN11; AKT2; EGFR; ERBB2; PRKCI; CDKN1B; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RPS6KB1 |
| Wnt & Beta catenin Signaling | CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2 |
| Insulin Receptor Signaling | PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1 |
| IL-6 Signaling | HSPB1; TRAF6; MAPKAPK2; ELK1; MAPK1; PTPN11; IKBKB; FOS; NFKB2; MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6 |
| Hepatic Cholestasis | PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF1; FGFR4; JUN; IL1R1; PRKCA; IL6 |
| IGF-1 Signaling | IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1 |
| NRF2-mediated Oxidative Stress Response | PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPIB; JUN; KEAP1; GSK3B; ATF4; PRKCA; EIF2AK3; HSP90AA1 |
| Hepatic Fibrosis/Hepatic Stellate Cell Activation | EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MMP1; STAT1; IL6; CTGF; MMP9 |
| PPAR Signaling | EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1 |

TABLE B-continued

Exemplary Genes controlling Cellular Functions

| CELLULAR FUNCTION | GENES |
|---|---|
| Fc Epsilon RI Signaling | PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA |
| G-Protein Coupled Receptor Signaling | PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA |
| Inositol Phosphate Metabolism | PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK |
| PDGF Signaling | EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 |
| VEGF Signaling | ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA |
| Natural Killer Cell Signaling | PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA |
| Cell Cycle: G1/S Checkpoint Regulation | HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6 |
| T Cell Receptor Signaling | RAC1; ELK1; MAPK1; IKBKB; CBL; PIK3CA; FOS; NFKB2; PIK3CB; PIK3C3; MAPK8; MAPK3; KRAS; RELA; PIK3C2A; BTK; LCK; RAF1; IKBKG; RELB; FYN; MAP2K2; PIK3R1; CHUK; MAP2K1; NFKB1; ITK; BCL10; JUN; VAV3 |
| Death Receptor Signaling | CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3 |
| FGF Signaling | RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF |
| GM-CSF Signaling | LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1 |
| Amyotrophic Lateral Sclerosis Signaling | BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 |
| JAK/Stat Signaling | PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1 |
| Nicotinate and Nicotinamide Metabolism | PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK |
| Chemokine Signaling | CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA |

TABLE B-continued

Exemplary Genes controlling Cellular Functions

| CELLULAR FUNCTION | GENES |
|---|---|
| IL-2 Signaling | ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3 |
| Synaptic Long Term Depression | PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA |
| Estrogen Receptor Signaling | TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2 |
| Protein Ubiquitination Pathway | TRAF6; SMURF1; BIRC4; BRCA1; UCHL1; NEDD4; CBL; UBE2I; BTRC; HSPA5; USP7; USP10; FBXW7; USP9X; STUB1; USP22; B2M; BIRC2; PARK2; USP8; USP1; VHL; HSP90AA1; BIRC3 |
| IL-10 Signaling | TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6 |
| VDR/RXR Activation | PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA |
| TGF-beta Signaling | EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5 |
| Toll-like Receptor Signaling | IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN |
| p38 MAPK Signaling | HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1 |
| Neurotrophin/TRK Signaling | NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4 |
| FXR/RXR Activation | INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1 |
| Synaptic Long Term Potentiation | PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA |
| Calcium Signaling | RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6 |
| EGF Signaling | ELK1; MAPK1; EGFR; PIK3CA; FOS; PIK3CB; PIK3C3; MAPK8; MAPK3; PIK3C2A; RAF1; JAK1; PIK3R1; STAT3; MAP2K1; JUN; PRKCA; SRF; STAT1 |
| Hypoxia Signaling in the Cardiovascular System | EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; HSP90AA1 |
| LPS/IL-1 Mediated Inhibition of RXR Function | IRAK1; MYD88; TRAF6; PPARA; RXRA; ABCA1; MAPK8; ALDH1A1; GSTP1; MAPK9; ABCB1; TRAF2; TLR4; TNF; MAP3K7; NR1H2; SREBF1; JUN; IL1R1 |
| LXR/RXR Activation | FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MMP9 |
| Amyloid Processing | PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP |
| IL-4 Signaling | AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1 |
| Cell Cycle: G2/M DNA Damage Checkpoint Regulation | EP300; PCAF; BRCA1; GADD45A; PLK1; BTRC; CHEK1; ATR; CHEK2; YWHAZ; TP53; CDKN1A; PRKDC; ATM; SFN; CDKN2A |
| Nitric Oxide Signaling in the Cardiovascular System | KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1 |

TABLE B-continued

Exemplary Genes controlling Cellular Functions

| CELLULAR FUNCTION | GENES |
|---|---|
| Purine Metabolism | NME2; SMARCA4; MYH9; RRM2; ADAR; EIF2AK4; PKM2; ENTPD1; RAD51; RRM2B; TJP2; RAD51C; NT5E; POLD1; NME1 |
| cAMP-mediated Signaling | RAP1A; MAPK1; GNAS; CREB1; CAMK2A; MAPK3; SRC; RAF1; MAP2K2; STAT3; MAP2K1; BRAF; ATF4 |
| Mitochondrial Dysfunction | SOD2; MAPK8; CASP8; MAPK10; MAPK9; CASP9; PARK7; PSEN1; PARK2; APP; CASP3 |
| Notch Signaling | HES1; JAG1; NUMB; NOTCH4; ADAM17; NOTCH2; PSEN1; NOTCH3; NOTCH1; DLL4 |
| Endoplasmic Reticulum Stress Pathway | HSPA5; MAPK8; XBP1; TRAF2; ATF6; CASP9; ATF4; EIF2AK3; CASP3 |
| Pyrimidine Metabolism | NME2; AICDA; RRM2; EIF2AK4; ENTPD1; RRM2B; NT5E; POLD1; NME1 |
| Parkinson's Signaling | UCHL1; MAPK8; MAPK13; MAPK14; CASP9; PARK7; PARK2; CASP3 |
| Cardiac & Beta Adrenergic Signaling | GNAS; GNAQ; PPP2R1A; GNB2L1; PPP2CA; PPP1CC; PPP2R5C |
| Glycolysis/Gluconeogenesis | HK2; GCK; GPI; ALDH1A1; PKM2; LDHA; HK1 |
| Interferon Signaling | IRF1; SOCS1; JAK1; JAK2; IFITM1; STAT1; IFIT3 |
| Sonic Hedgehog Signaling | ARRB2; SMO; GLI2; DYRK1A; GLI1; GSK3B; DYRK1B |
| Glycerophospholipid Metabolism | PLD1; GRN; GPAM; YWHAZ; SPHK1; SPHK2 |
| Phospholipid Degradation | PRDX6; PLD1; GRN; YWHAZ; SPHK1; SPHK2 |
| Tryptophan Metabolism | SIAH2; PRMT5; NEDD4; ALDH1A1; CYP1B1; SIAH1 |
| Lysine Degradation | SUV39H1; EHMT2; NSD1; SETD7; PPP2R5C |
| Nucleotide Excision Repair Pathway | ERCC5; ERCC4; XPA; XPC; ERCC1 |
| Starch and Sucrose Metabolism | UCHL1; HK2; GCK; GPI; HK1 |
| Aminosugars Metabolism | NQO1; HK2; GCK; HK1 |
| Arachidonic Acid Metabolism | PRDX6; GRN; YWHAZ; CYP1B1 |
| Circadian Rhythm Signaling | CSNK1E; CREB1; ATF4; NR1D1 |
| Coagulation System | BDKRB1; F2R; SERPINE1; F3 |
| Dopamine Receptor Signaling | PPP2R1A; PPP2CA; PPP1CC; PPP2R5C |
| Glutathione Metabolism | IDH2; GSTP1; ANPEP; IDH1 |
| Glycerolipid Metabolism | ALDH1A1; GPAM; SPHK1; SPHK2 |
| Linoleic Acid Metabolism | PRDX6; GRN; YWHAZ; CYP1B1 |
| Methionine Metabolism | DNMT1; DNMT3B; AHCY; DNMT3A |
| Pyruvate Metabolism | GLO1; ALDH1A1; PKM2; LDHA |
| Arginine and Proline Metabolism | ALDH1A1; NOS3; NOS2A |
| Eicosanoid Signaling | PRDX6; GRN; YWHAZ |
| Fructose and Mannose Metabolism | HK2; GCK; HK1 |
| Galactose Metabolism | HK2; GCK; HK1 |
| Stilbene, Coumarine and Lignin Biosynthesis | PRDX6; PRDX1; TYR |
| Antigen Presentation Pathway | CALR; B2M |
| Biosynthesis of Steroids | NQO1; DHCR7 |
| Butanoate Metabolism | ALDH1A1; NLGN1 |
| Citrate Cycle | IDH2; IDH1 |
| Fatty Acid Metabolism | ALDH1A1; CYP1B1 |
| Glycerophospholipid Metabolism | PRDX6; CHKA |
| Histidine Metabolism | PRMT5; ALDH1A1 |
| Inositol Metabolism | ERO1L; APEX1 |
| Metabolism of Xenobiotics by Cytochrome p450 | GSTP1; CYP1B1 |
| Methane Metabolism | PRDX6; PRDX1 |
| Phenylalanine Metabolism | PRDX6; PRDX1 |
| Propanoate Metabolism | ALDH1A1; LDHA |
| Selenoamino Acid Metabolism | PRMT5; AHCY |
| Sphingolipid Metabolism | SPHK1; SPHK2 |
| Aminophosphonate Metabolism | PRMT5 |
| Androgen and Estrogen Metabolism | PRMT5 |
| Ascorbate and Aldarate Metabolism | ALDH1A1 |
| Bile Acid Biosynthesis | ALDH1A1 |
| Cysteine Metabolism | LDHA |
| Fatty Acid Biosynthesis | FASN |

TABLE B-continued

Exemplary Genes controlling Cellular Functions

| CELLULAR FUNCTION | GENES |
|---|---|
| Glutamate Receptor Signaling | GNB2L1 |
| NRF2-mediated Oxidative Stress Response | PRDX1 |
| Pentose Phosphate Pathway | GPI |
| Pentose and Glucuronate Interconversions | UCHL1 |
| Retinol Metabolism | ALDH1A1 |
| Riboflavin Metabolism | TYR |
| Tyrosine Metabolism | PRMT5, TYR |
| Ubiquinone Biosynthesis | PRMT5 |
| Valine, Leucine and Isoleucine Degradation | ALDH1A1 |
| Glycine, Serine and Threonine Metabolism | CHKA |
| Lysine Degradation | ALDH1A1 |
| Pain/Taste | TRPM5; TRPA1 |
| Pain | TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkar1a; Prkar2a |
| Mitochondrial Function | AIF; CytC; SMAC (Diablo); Aifm-1; Aifm-2 |
| Developmental Neurology | BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wnt10a; Wnt10b; Wnt16); beta-catenin; Dkk-1; Frizzled related proteins; Otx-2; Gbx2; FGF-8; Reelin; Dab1; unc-86 (Pou4f1 or Brn3a); Numb; Reln |

Thus, also described herein are methods of inducing one or more mutations in a eukaryotic or prokaryotic cell (in vitro, i.e. in an isolated eukaryotic cell) as herein discussed comprising delivering to cell a vector as described herein. The mutation(s) can include the introduction, deletion, or substitution of one or more nucleotides at a target sequence of cell(s). In some embodiments, the mutations can include the introduction, deletion, or substitution of 1-75 nucleotides at each target sequence of said cell(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence. The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s). The mutations can include the introduction, deletion, or substitution of 20, 21, 22, 23, 24, 25, 26, 27, 28, 29, 30, 35, 40, 45, 50, or 75 nucleotides at each target sequence of said cell(s). The mutations can include the introduction, deletion, or substitution of 40, 45, 50, 75, 100, 200, 300, 400 or 500 nucleotides at each target sequence of said cell(s). The mutations can include the introduction, deletion, or substitution of 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300, 7400, 7500, 7600, 7700, 7800, 7900, 8000, 8100, 8200, 8300, 8400, 8500, 8600, 8700, 8800, 8900, 9000, 9100, 9200, 9300, 9400, 9500, 9600, 9700, 9800, or 9900 to 10000 nucleotides at each target sequence of said cell(s).

In some embodiments, the modifications can include the introduction, deletion, or substitution of nucleotides at each target sequence of said cell(s) via nucleic acid components (e.g. guide(s) RNA(s) or sgRNA(s)), such as those mediated by a CRISPR-Cas system.

In some embodiments, the modifications can include the introduction, deletion, or substitution of nucleotides at a target or random sequence of said cell(s) via a non CRISPR-Cas system or technique. Such techniques are discussed elsewhere herein, such as where engineered cells and methods of generating the engineered cells and organisms are discussed.

For minimization of toxicity and off-target effect when using a CRISPR-Cas system, it may be important to control the concentration of Cas mRNA and guide RNA delivered. Optimal concentrations of Cas mRNA and guide RNA can be determined by testing different concentrations in a cellular or non-human eukaryote animal model and using deep sequencing the analyze the extent of modification at potential off-target genomic loci. Alternatively, to minimize the level of toxicity and off-target effect, Cas nickase mRNA (for example S. pyogenes Cas9-like with the D10A mutation) can be delivered with a pair of guide RNAs targeting a site of interest. Guide sequences and strategies to minimize toxicity and off-target effects can be as in WO 2014/093622 (PCT/US2013/074667); or, via mutation as herein.

Typically, in the context of an endogenous CRISPR system, formation of a CRISPR complex (comprising a guide sequence hybridized to a target sequence and complexed with one or more Cas proteins) results in cleavage of one or both strands in or near (e.g. within 1, 2, 3, 4, 5, 6, 7, 8, 9, 10, 20, 50, or more base pairs from) the target sequence. Without wishing to be bound by theory, a tracr sequence, which may comprise or consist of all or a portion of a wild-type tracr sequence (e.g. about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to a guide sequence.

In one embodiment, the invention provides a method of modifying a target polynucleotide in a eukaryotic cell. In some embodiments, the method includes delivering an engineered cell described herein and/or an engineered AAV capsid particle described herein having a CRISPR-Cas molecule as a cargo molecule to a subject and/or cell. The CRISPR-Cas system molecule(s) delivered can complex to bind to the target polynucleotide, e.g., to effect cleavage of said target polynucleotide, thereby modifying the target polynucleotide, wherein the CRISPR complex comprises a CRISPR enzyme complexed with a guide sequence hybridized to a target sequence within said target polynucleotide, wherein said guide sequence can be linked to a tracr mate sequence which in turn hybridizes to a tracr sequence. In some embodiments, said cleavage comprises cleaving one or two strands at the location of the target sequence by said CRISPR enzyme. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein one or more vectors comprise the CRISPR enzyme and one or more vectors drive expression of one or more of: the guide sequence linked to the tracr mate sequence, and the tracr sequence. In some embodiments, said CRISPR enzyme drive expression of one or more of: the guide sequence linked to the tracr mate sequence, and the tracr sequence. In some embodiments such CRISPR enzyme are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject. In some embodiments, the isolated cells can be returned to the subject after delivery of one or more engineered viral particles or other engineered delivery vehicles to the isolated cell. In some embodiments, the isolated cells can be returned to the subject after delivering one or more molecules of the engineered delivery system described herein to the isolated cell, thus making the isolated cells engineered cells as previously described.

Screening and Cell Selection

The engineered muscle-specific delivery system vectors, engineered cells, engineered viral particles, and/or engineered muscle-specific delivery systems described herein can be used in a screening assay and/or cell selection assay. The engineered delivery system vectors, engineered cells, and/or engineered viral particles, and/or other engineered delivery system of the present invention can be delivered to a subject and/or cell. In some embodiments, the cell is a eukaryotic cell. The cell can be in vitro, ex vivo, in situ, or in vivo. The engineered delivery system molecules, delivery vehicles, vectors, engineered cells, and/or engineered viral particles described herein can introduce an exogenous molecule or compound to subject or cell to which they are delivered. The presence of an exogenous molecule or compound can be detected which can allow for identification of a cell and/or attribute thereof. In some embodiments, the delivered molecules or particles can impart a gene or other nucleotide modification (e.g. mutations, gene or polynucleotide insertion and/or deletion, etc.). In some embodiments the nucleotide modification can be detected in a cell by sequencing. In some embodiments, the nucleotide modification can result in a physiological and/or biological modification to the cell that results in a detectable phenotypic change in the cell, which can allow for detection, identification, and/or selection of the cell. In some embodiments, the phenotypic change can be cell death, such as embodiments where binding of a CRISPR complex to a target polynucleotide results in cell death. Embodiments of the invention allow for selection of specific cells without requiring a selection marker or a two-step process that may include a counter-selection system. The cell(s) may be prokaryotic or eukaryotic cells.

In one embodiment the invention provides for a method of selecting one or more cell(s) by introducing one or more mutations in a gene in the one or more cell(s), the method comprising: introducing one or more vectors, which can include one or more engineered delivery system molecules or vectors described elsewhere herein, into the cell(s), wherein the one or more vectors can include a CRISPR enzyme and/or drive expression of one or more of: a guide sequence linked to a tracr mate sequence, a tracr sequence, and an editing template; or other polynucleotide to be inserted into the cell and/or genome thereof; wherein, for example that which is being expressed is within and expressed in vivo by the CRISPR enzyme and/or the editing template, when included, comprises the one or more mutations that abolish CRISPR enzyme cleavage; allowing homologous recombination of the editing template with the target polynucleotide in the cell(s) to be selected; allowing a CRISPR complex to bind to a target polynucleotide to effect cleavage of the target polynucleotide within said gene, wherein the CRISPR complex comprises the CRISPR enzyme complexed with (1) the guide sequence that is hybridized to the target sequence within the target polynucleotide, and (2) the tracr mate sequence that is hybridized to the tracr sequence, wherein binding of the CRISPR complex to the target polynucleotide induces cell death, thereby allowing one or more cell(s) in which one or more mutations have been introduced to be selected. In a preferred embodiment, the CRISPR enzyme is a Cas protein. In another embodiment of the invention the cell to be selected may be a eukaryotic cell.

The screening methods involving the engineered AAV capsid system molecules, vectors, engineered cells, and/or engineered AAV capsid particles, including but not limited to those that deliver one more CRISPR-Cas system molecules to cell, can be used in detection methods such as fluorescence in situ hybridization (FISH). In some embodiments, one or more components of an engineered CRISPR-Cas system that includes a catalytically inactive Cas protein, can be delivered by an engineered delivery system molecule (such as an engineered virus particle or other engineered delivery vehicle), engineered cell, or other composition including an engineered muscle-specific targeting moiety described elsewhere herein to a cell and used in a FISH method. The CRISPR-Cas system can include an inactivated Cas protein (dCas) (e.g. a dCas9), which lacks the ability to produce DNA double-strand breaks may be fused with a marker, such as fluorescent protein, such as the enhanced green fluorescent protein (eEGFP) and co-expressed with small guide RNAs to target pericentric, centric and telomeric repeats in vivo. The dCas system can be used to visualize both repetitive sequences and individual genes in the human genome. Such new applications of labelled dCas, dCas CRISPR-Cas systems, engineered AAV delivery system molecules, engineered cells, and/or engineered delivery particles (viral or non-viral) can be used in imaging cells and studying the functional nuclear architecture, especially in cases with a small nucleus volume or complex 3-D structures. (Chen B, Gilbert L A, Cimini B A, Schnitzbauer J, Zhang W, Li G W, Park J, Blackburn E H, Weissman J S, Qi L S, Huang B. 2013. Dynamic imaging of genomic loci in living human cells by an optimized CRISPR/Cas system. Cell 155(7): 1479-91. doi: 10.1016/j.cell.2013.12.001., the teachings of which can be applied and/or adapted to the CRISPR systems described herein. A similar approach involving a polynucleotide fused to a marker (e.g. a fluorescent marker) can be delivered to a cell via an engineered AAV capsid system molecule, vector, engineered cell, and/or engineered AAV capsid particle described herein and integrated into the genome of the cell and/or otherwise interact with a region of the genome of a cell for FISH analysis.

Similar approaches for studying other cell organelles and other cell structures can be accomplished by delivering to the cell (e.g. via an engineered delivery AAV capsid molecule, engineered cell, and/or engineered AAV capsid particle described herein) one or more molecules fused to a marker (such as a fluorescent marker), wherein the molecules fused to the marker are capable of targeting one or more cell structures. By analyzing the presence of the markers, one can identify and/or image specific cell structures.

In some embodiments, the engineered muscle-specific delivery system molecules can be used in a screening assay inside or outside of a cell. In some embodiments, the screening assay can include delivering a CRISPR-Cas cargo molecule(s) via an engineered muscle-specific delivery particle of the present invention.

Use of the present system in screening is also provided by the present invention, e.g., gain of function screens. Cells which are artificially forced to overexpress a gene are be able to down regulate the gene over time (re-establishing equilibrium) e.g. by negative feedback loops. By the time the screen starts the unregulated gene might be reduced again. Other screening assays are discussed elsewhere herein.

In an embodiment, the invention provides a cell from or of an in vitro method of delivery, wherein the method comprises contacting the delivery system with a cell, optionally a eukaryotic cell, whereby there is delivery into the cell of constituents of the delivery system, and optionally obtaining data or results from the contacting, and transmitting the data or results.

In an embodiment, the invention provides a cell from or of an in vitro method of delivery, wherein the method comprises contacting the delivery system with a cell, optionally a eukaryotic cell, whereby there is delivery into the cell of constituents of the delivery system, and optionally obtaining data or results from the contacting, and transmitting the data or results; and wherein the cell product is altered compared to the cell not contacted with the delivery system, for example altered from that which would have been wild type of the cell but for the contacting. In an embodiment, the cell product is non-human or animal. In some embodiments, the cell product is human.

In some embodiments, a host cell is transiently or non-transiently transfected with one or more vectors described herein. In some embodiments, a cell is transfected as it naturally occurs in a subject optionally to be reintroduced therein. In some embodiments, a cell that is transfected is taken from a subject. In some embodiments, the cell obtained from or is derived from cells taken from a subject, such as a cell line. Delivery mechanisms and techniques of the engineered muscle-specific delivery system and particles thereof that are described elsewhere herein.

In some embodiments it is envisaged to introduce the engineered muscle-specific delivery system molecule(s)) directly to the host cell. For instance, the engineered muscle-specific delivery system molecule(s) can be delivered together with one or more cargo molecules that are packaged into an engineered muscle-specific viral particle or contained in or coupled to a non-viral engineered muscle-specific delivery particle.

In some embodiments, the invention provides a method of expressing an engineered delivery molecule and cargo molecule to be packaged in an engineered viral particle (such as an engineered muscle-specific AAV particle) in a cell that can include the step of introducing the vector according any of the vector delivery systems disclosed herein.

The invention is further described in the following examples, which do not limit the scope of the invention described in the claims.

EXAMPLES

Figure 2:
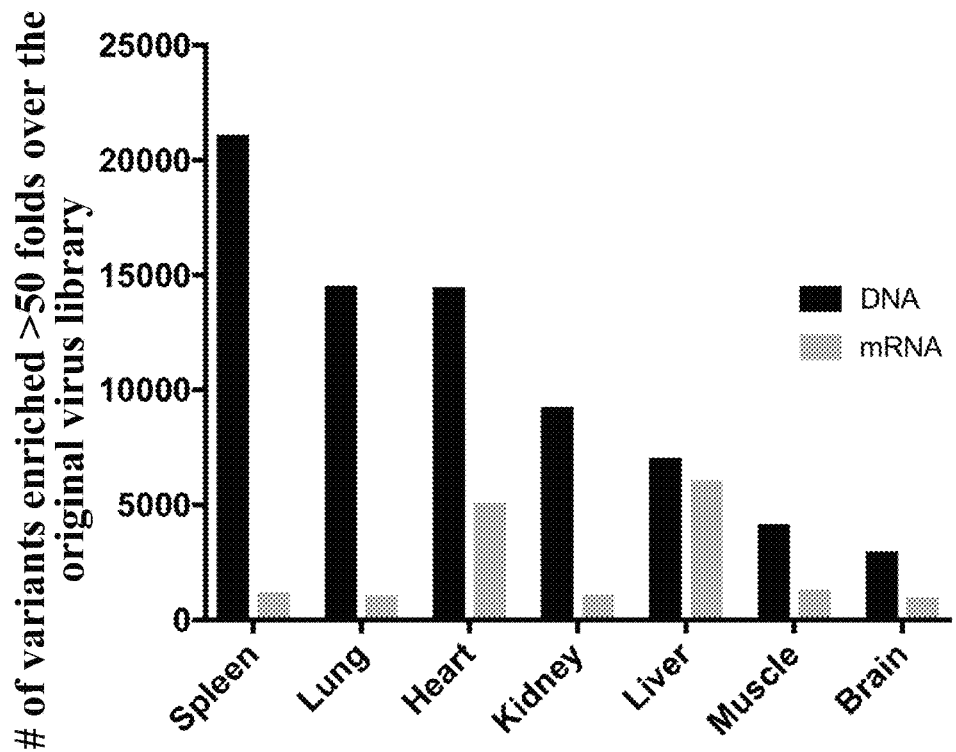
FIG. 2 shows a graph that can demonstrate that mRNA-based selection of AAV variants can be more stringent than DNA-based selection. The virus library was expressed under the control of a CMV promoter.

Example 1—mRNA Based Detection Methods are More Stringent for Selection of AAV Variants FIG. 1 demonstrates the adeno-associated virus (AAV) transduction mechanism, which results in production of mRNA. As is demonstrated in FIG. 1, functional transduction of a cell by an AAV particle can result in the production of an mRNA strand. Non-functional transduction would not produce such a product despite the viral genome being detectable using a DNA-based assay. Thus, mRNA-based detection assays to detect transduction by e.g. an AAV can be more stringent and provide feedback as to the functionality of a virus particle that is able to functionally transduce a cell. FIG. 2 shows a graph that can demonstrate that mRNA-based selection of AAV variants can be more stringent than DNA-based selection. The virus library was expressed under the control of a CMV promoter.

Figure 3A:
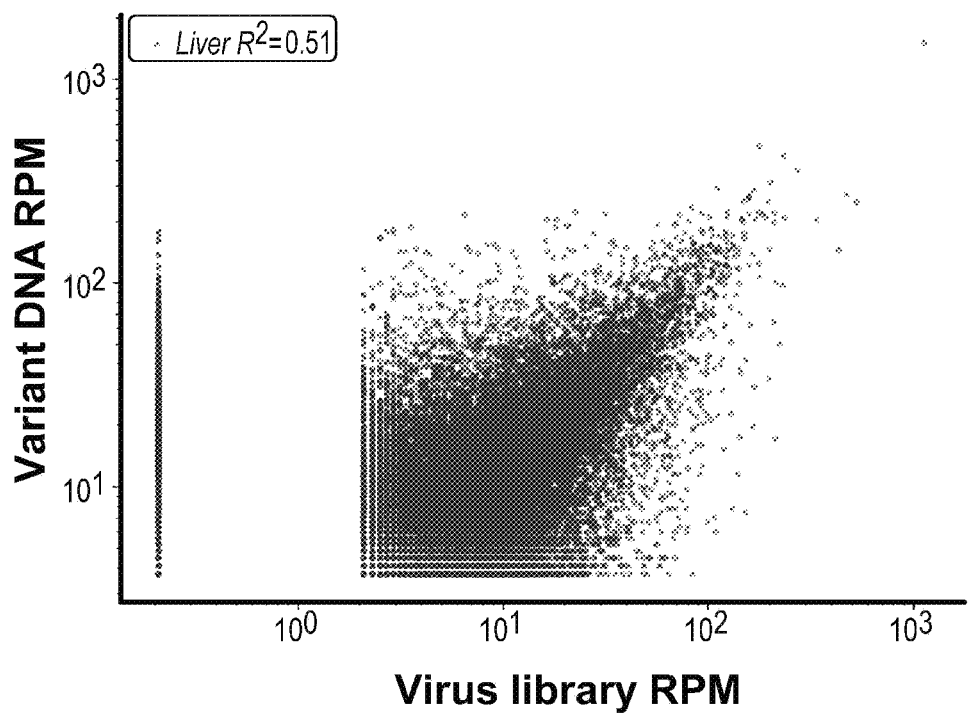
FIGS. 3A-3B show graphs that can demonstrate a correlation between the virus library and vector genome DNA (FIG. 3A) and mRNA (FIG. 3B) in the liver.
Figure 3B:
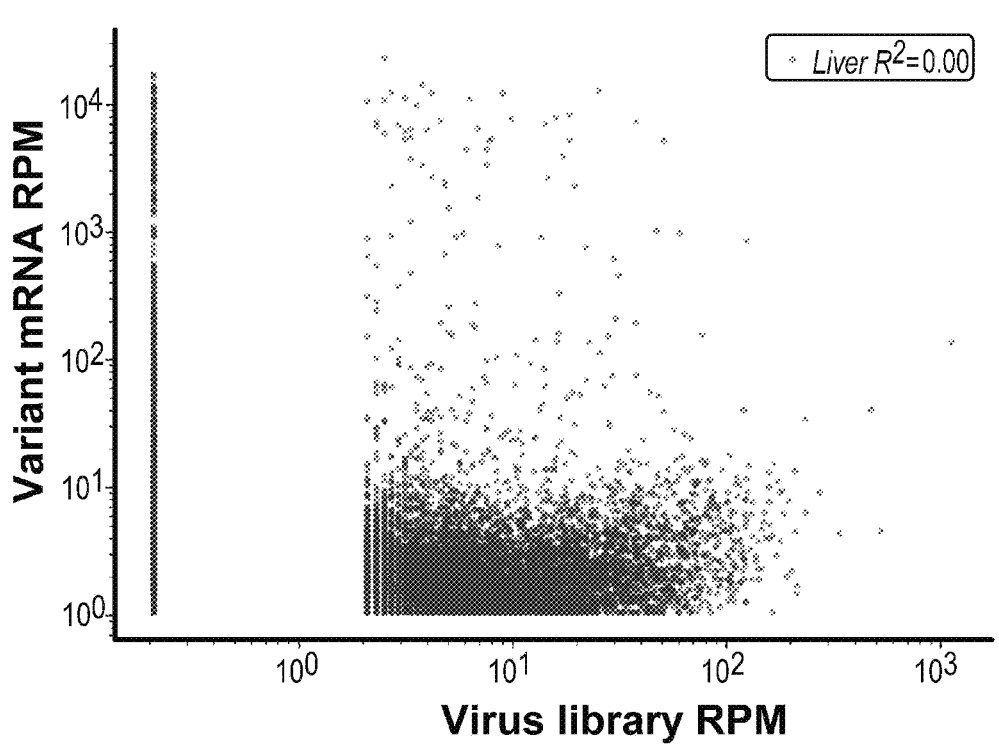
Figure 4A:
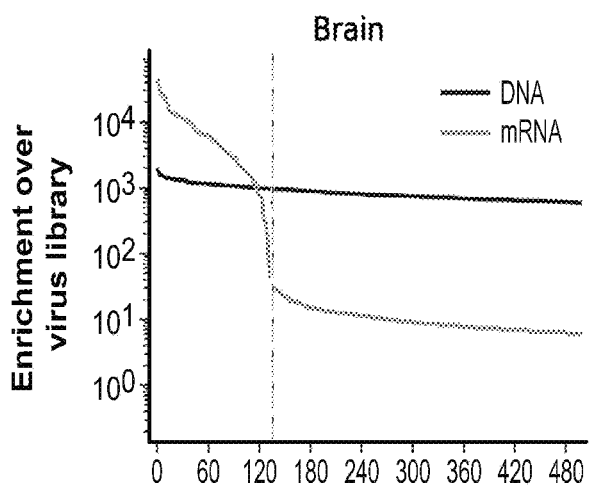
FIGS. 4A-4F show graphs that can demonstrate capsid variants present at the DNA level and expressed at the mRNA level identified in different tissues. For this experiment, the virus library was expressed under the control of a CMV promoter.
Figure 4B:
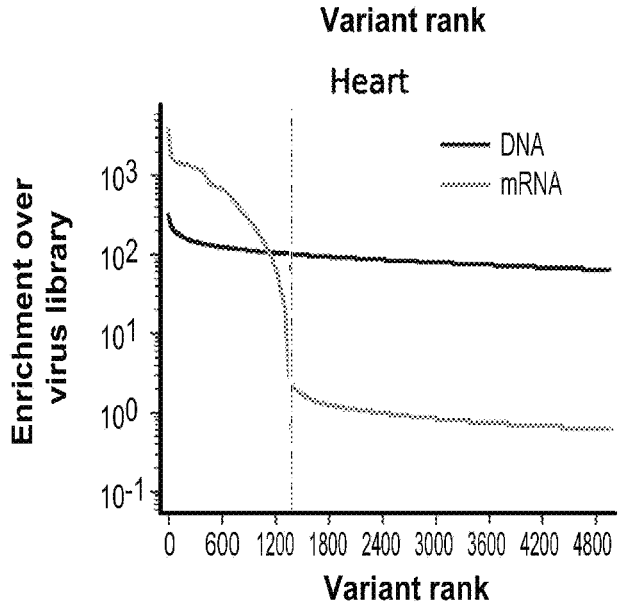
Figure 4C:
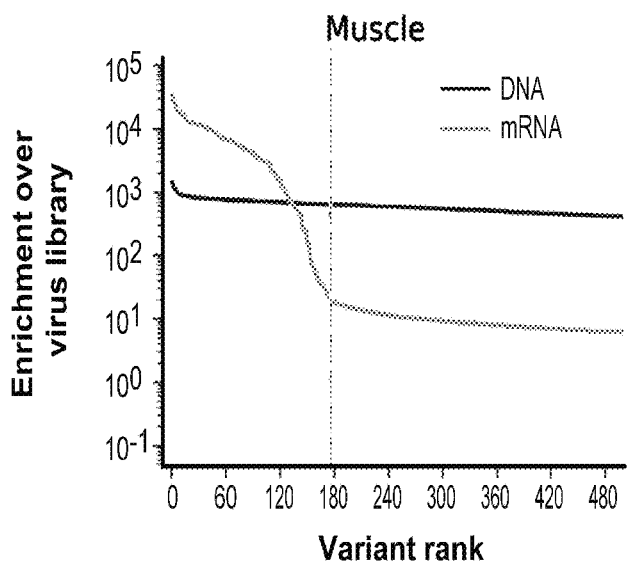
Figure 4D:
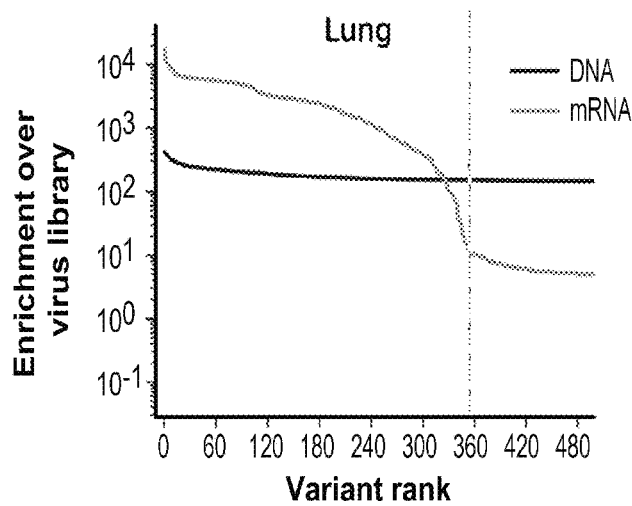
Figure 4E:
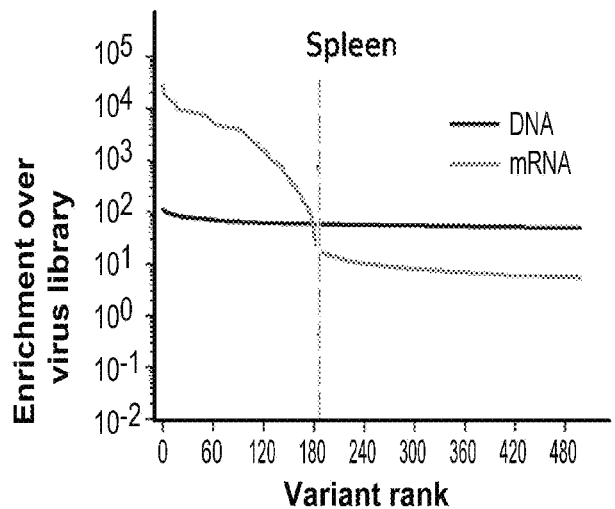
Figure 4F:
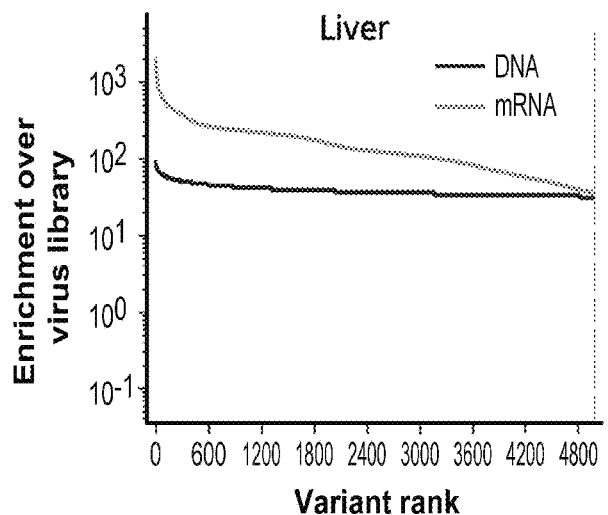

Example 2—mRNA Based Detection Methods can be Used to Detect AAV Capsid Variants from a Capsid Variant Library FIGS. 3A-3B show graphs that can demonstrate a correlation between the virus library and vector genome DNA (FIG. 3A) and mRNA (FIG. 3B) in the liver. FIGS. 4A-4F show graphs that can demonstrate capsid variants expressed at the mRNA level identified in different tissues.

Example 3—Capsid mRNA Expression can be Driven by Tissue Specific Promoters

Figure 5A:
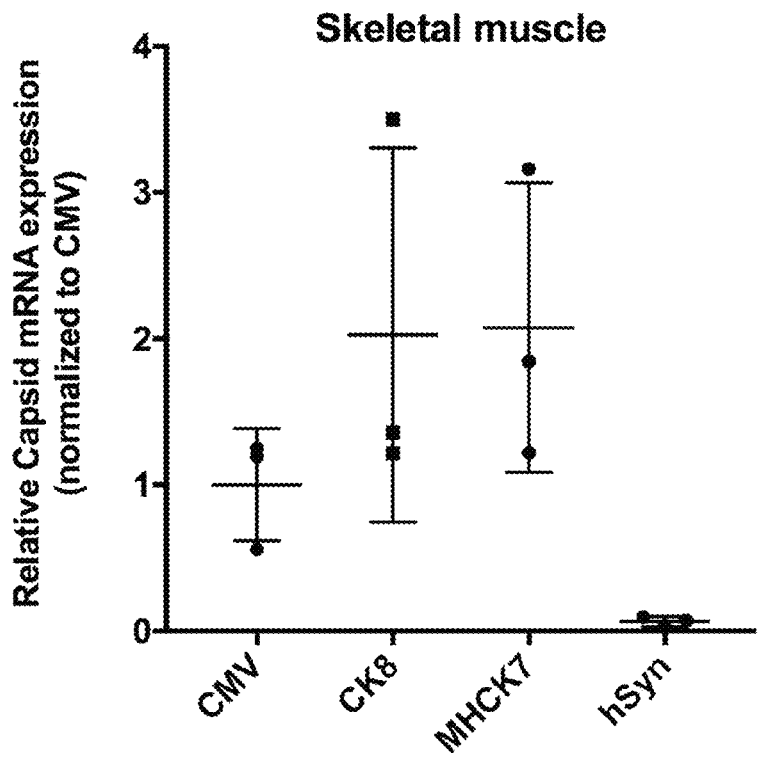
FIGS. 5A-5C show graphs that can demonstrate capsid mRNA expression in different tissues under the control of cell-type specific promoters (as noted on x-axis). CMV was included as an exemplary constitutive promoter. CK8 is a muscle-specific promoter. MHCK7 is a muscle-specific promoter. hSyn is a neuron specific promoter. Expression levels from the cell type-specific promoters have been normalized based on expression levels from the constitutive CMV promoter in each tissue.
Figure 5B:
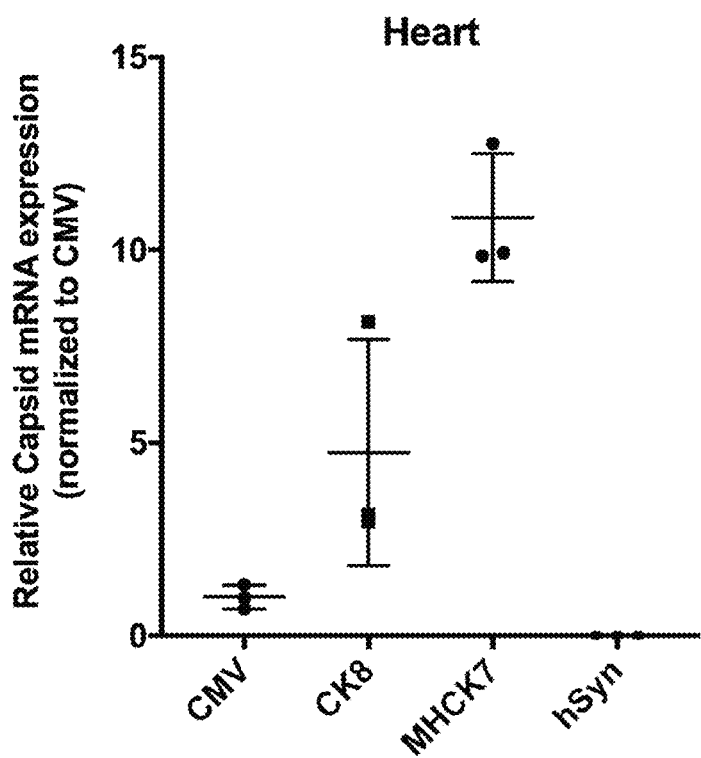
Figure 5C:
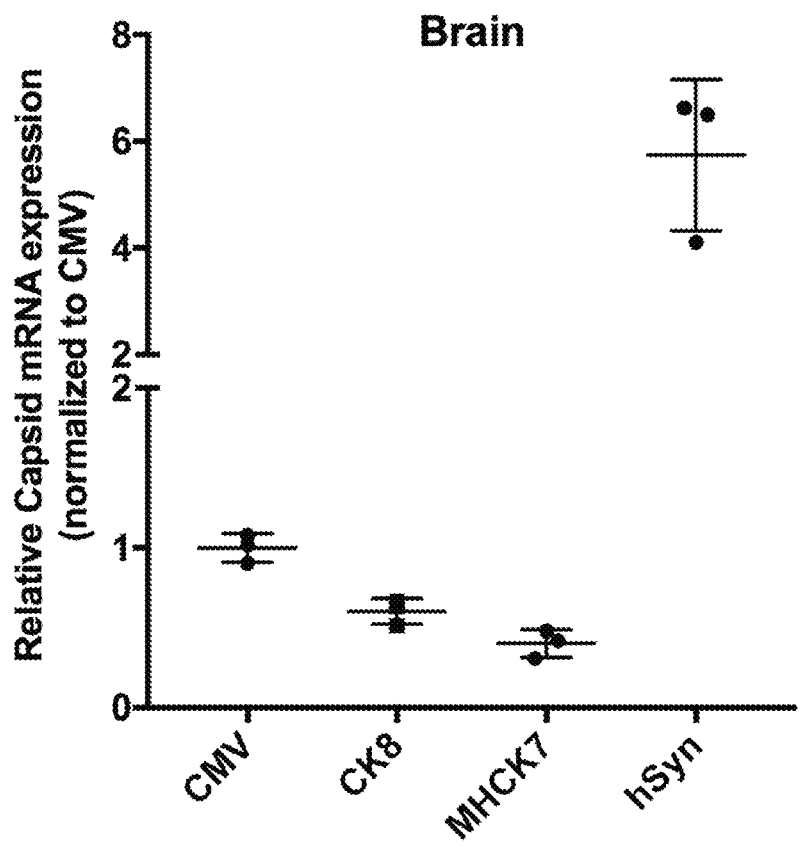

FIGS. 5A-5C show graphs that can demonstrate capsid mRNA expression in different tissues under the control of cell-type specific promoters (as noted on x-axis). CMV was included as an exemplary constitutive promoter. CK8 is a muscle-specific promoter. MHCK7 is a muscle-specific promoter. hSyn is a neuron specific promoter.

Figure 9:
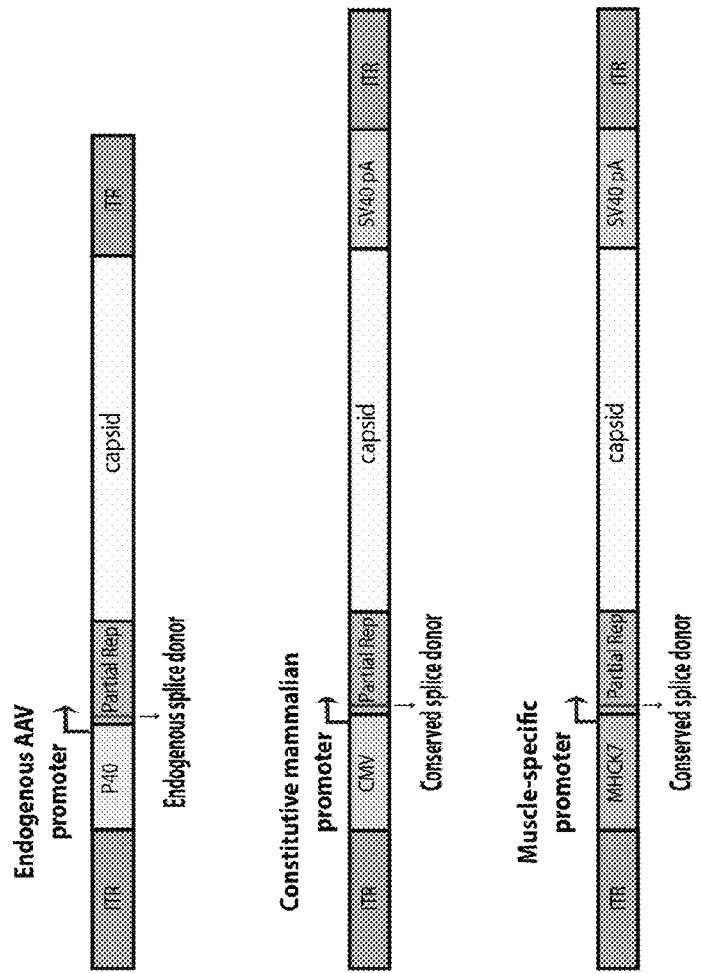
FIG. 9 shows schematic vector maps of representative AAV capsid plasmid library vectors (see e.g.

Example 4—Capsid Variant Library Generation, Variant Screening, and Variant Identification Generally, an AAV capsid library can be generated by expressing engineered capsid vectors each containing an engineered AAV capsid polynucleotide previously described in an appropriate AAV producer cell line. See e.g. FIG. 8. This can generate an AAV capsid library that can contain one more desired cell-specific engineered AAV capsid variant. FIG. 7 shows a schematic demonstrating embodiments of generating an AAV capsid variant library, particularly insertion of a random n-mer (n=3-15 amino acids) into a wild-type AAV, e.g. AAV9. In this example, random 7-mers were inserted between aa588-589 of variable region VIII of AAV9 viral protein and used to form the viral genome containing vectors with one variant per vector. As shown in FIG. 8, the capsid variant vector library was used to generate AAV particles where each capsid variant encapsulated its coding sequence as the vector genome. FIG. 9 shows vector maps of representative AAV capsid plasmid library vectors (see e.g. FIG. 8) that can be used in an AAV vector system to generate an AAV capsid variant library. The library can be generated with the capsid variant polynucleotide under the control of a tissue specific promoter or constitutive promoter. The library was also made with capsid variant polynucleotide that included a polyadenylation signal.

As shown in FIG. 6 the AAV capsid library can be administered to various non-human animals for a first round of mRNA-based selection. As shown in FIG. 1, the transduction process by AAVs and related vectors can result in the production of an mRNA molecule that is reflective of the genome of the virus that transduced the cell. As is at least demonstrated in the Examples herein, mRNA based-selection can be more specific and effective to determine a virus particle capable of functionally transducing a cell because it is based on the functional product produced as opposed to just detecting the presence of a virus particle in the cell by measuring the presence of viral DNA.

After first-round administration, one or more engineered AAV virus particles having a desired capsid variant can then be used to form a filtered AAV capsid library. Desirable AAV virus particles can be identified by measuring the mRNA expression of the capsid variants and determining which variants are highly expressed in the desired cell type(s) as compared to non-desired cells type(s). Those that are highly expressed in the desired cell, tissue, and/or organ type are the desired AAV capsid variant particles. In some embodiments, the AAV capsid variant encoding polynucleotide is under control of a tissue-specific promoter that has selective activity in the desired cell, tissue, or organ.

The engineered AAV capsid variant particles identified from the first round can then be administered to various non-human animals. In some embodiments, the animals used in the second round of selection and identification are not the same as those animals used for first round selection and identification. Similar to round 1, after administration the top expressing variants in the desired cell, tissue, and/or organ type(s) can be identified by measuring viral mRNA expression in the cells. The top variants identified after round two can then be optionally barcoded and optionally pooled. In some embodiments, top variants from the second round can then be administered to a non-human primate to identify the top cell-specific variant(s), particularly if the end use for the top variant is in humans. Administration at each round can be systemic.

Figure 10:
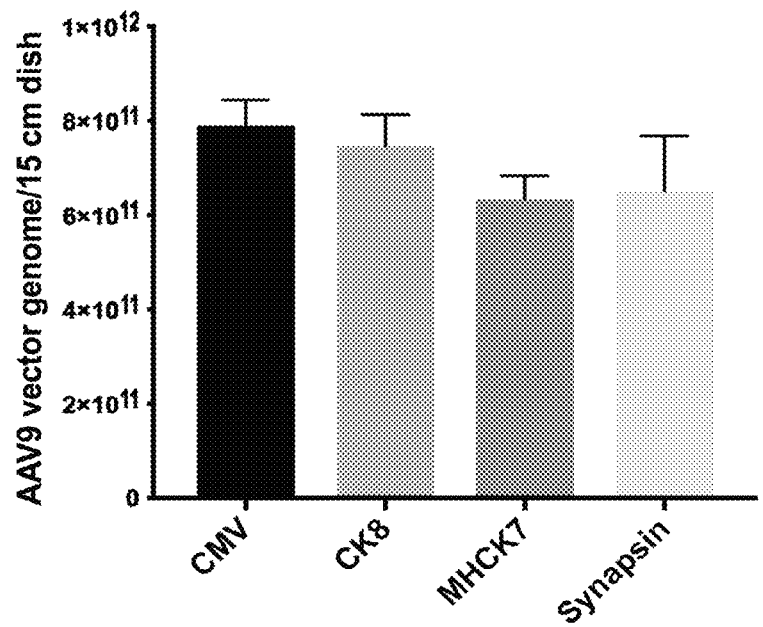
FIG. 10 shows a graph that can demonstrate the viral titer (calculated as AAV9 vector genome/15 cm dish) produced by constructs containing different constitutive and cell-type specific mammalian promoters.
Figure 11A:
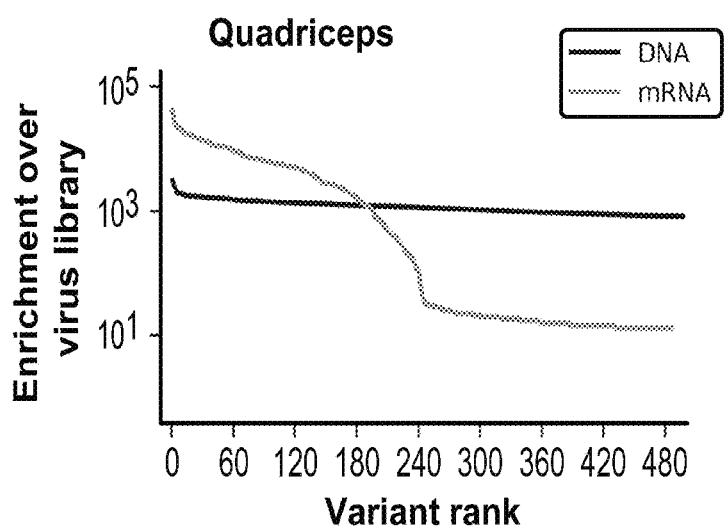
FIGS. 11A-11F show graphs that can demonstrate the results obtained after the first round of selection in C57BL/6 mice using a capsid library expressed under the control of the MHCK7 muscle-specific promoter.
Figure 11B:
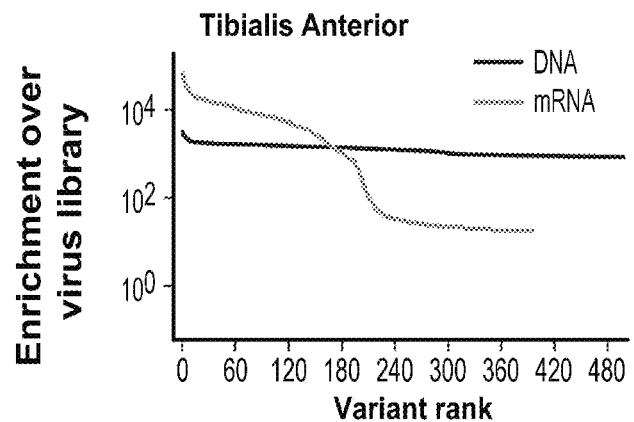
Figure 11C:
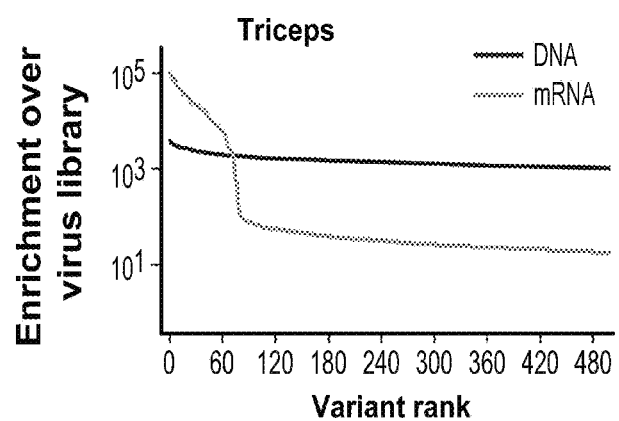
Figure 11D:
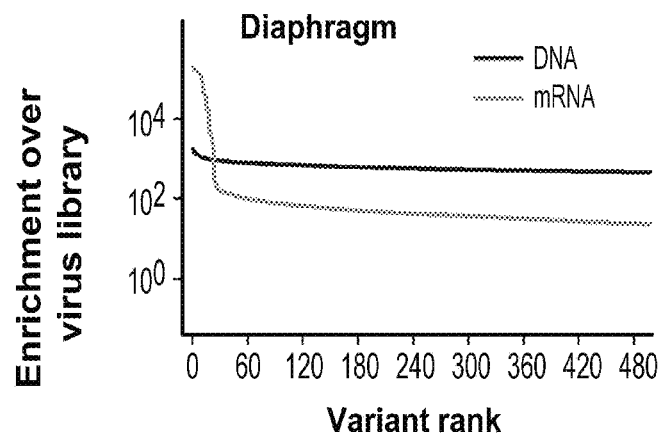
Figure 11E:
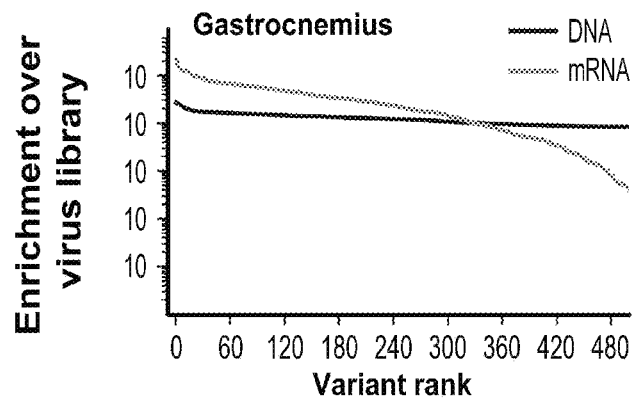
Figure 11F:
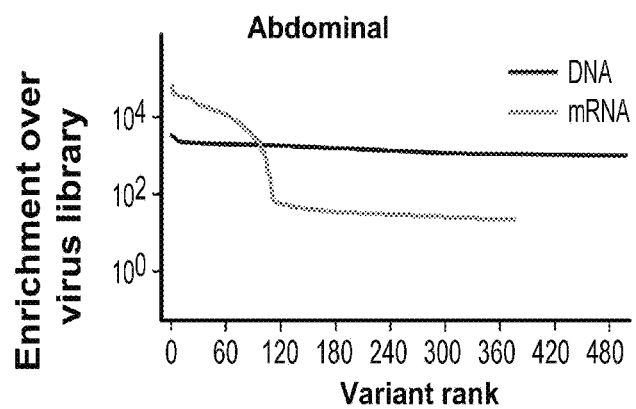
Figure 12A:
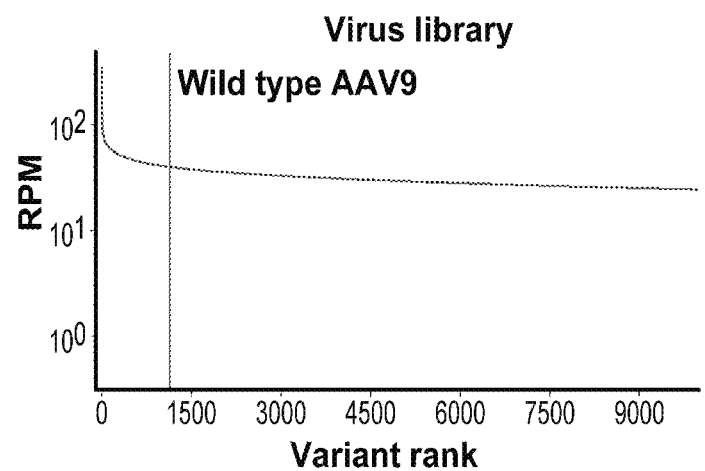
FIGS. 12A-12D show graphs that can demonstrate the results obtained after the second round of selection in C57BL/6 mice using a capsid library expressed under the control of the MHCK7 muscle-specific promoter.
Figure 12B:
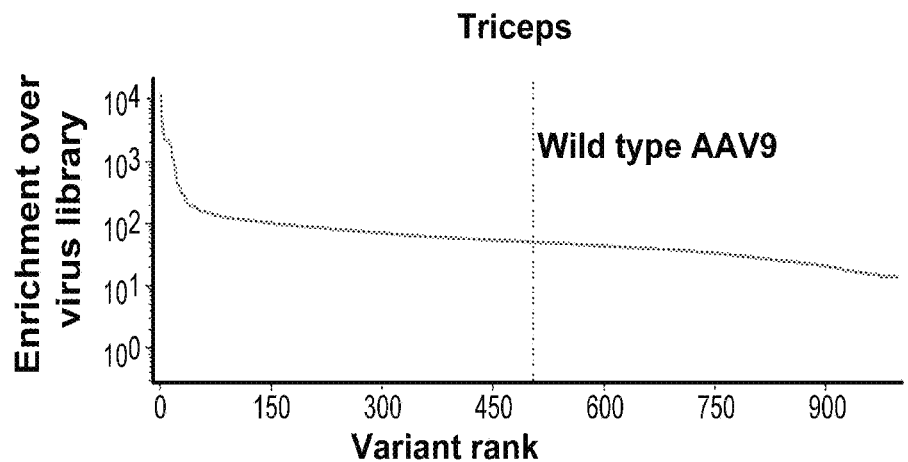
Figure 12C:
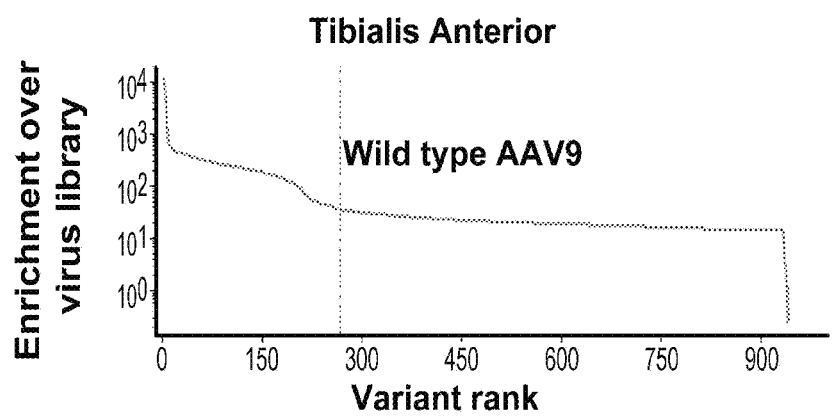
Figure 12D:
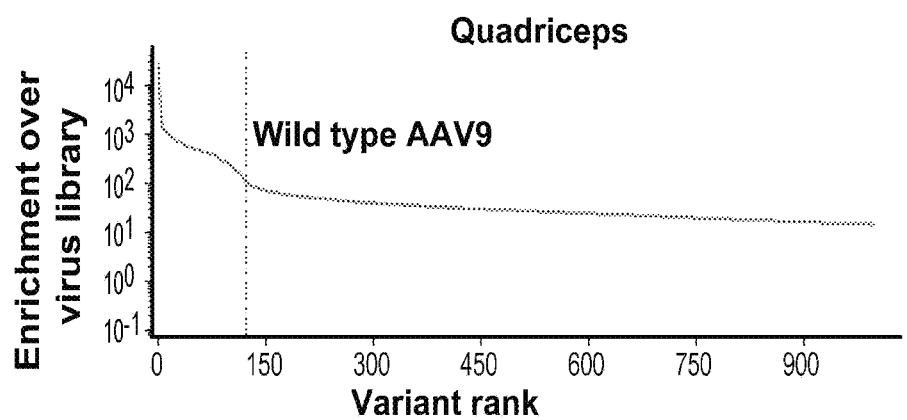

FIG. 10 shows a graph that can demonstrate the viral titer (calculated as AAV9 vector genome/15 cm dish) produced by libraries generated using different promoters. As demonstrated in FIG. 10, virus titer was not affected significantly be the use of different promoters.

FIGS. 11A-11F show graphs that can demonstrate the results obtained after the first round of selection in C57BL/6 mice using a capsid library expressed under the control of the MHCK7 muscle-specific promoter.

FIGS. 12A-12D show graphs that can demonstrate the results obtained after the second round of selection in C57BL/6 mice.

Figure 13A:
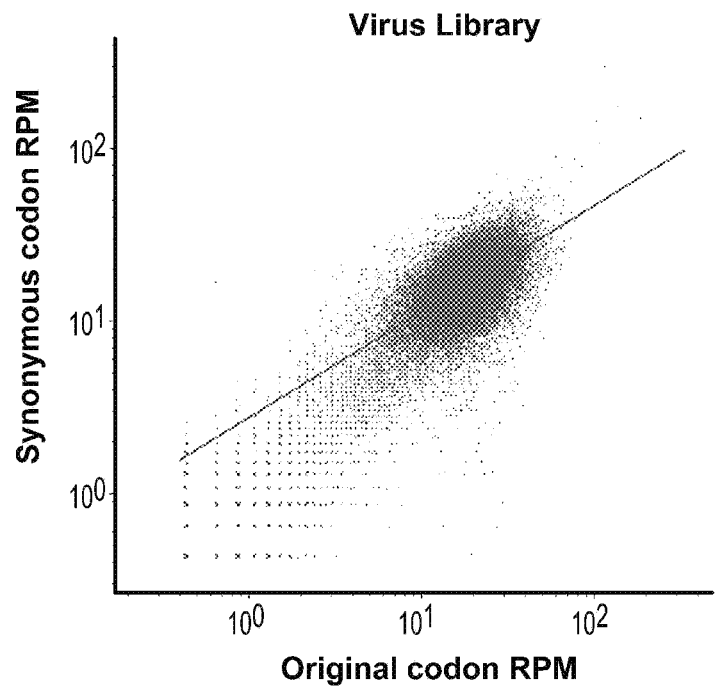
FIGS. 13A-13B shows graphs that can demonstrate a correlation between the abundance of variants encoded by synonymous codons.
Figure 13B:
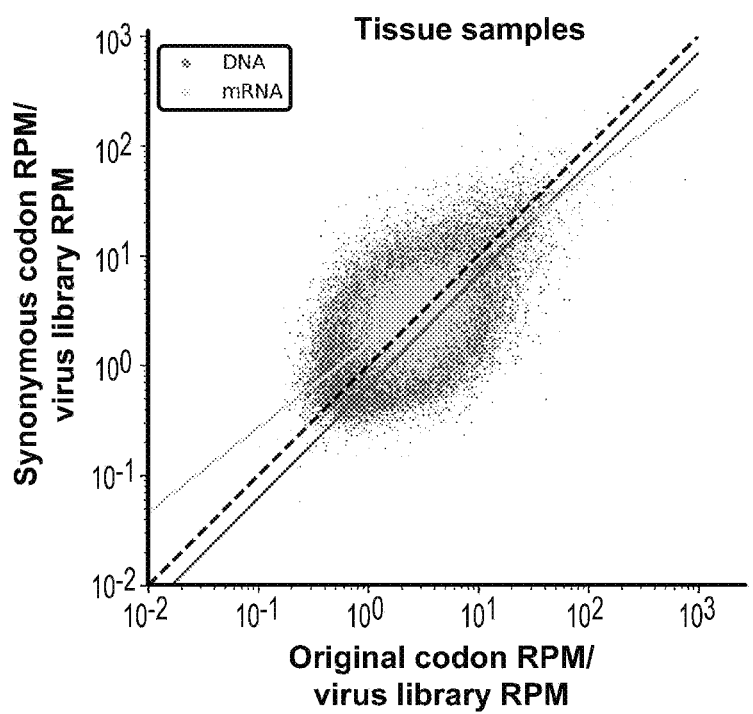

FIGS. 13A-13B shows graphs that can demonstrate a correlation between the abundance of variants encoded by synonymous codons. This graph can demonstrate that there is little to no codon bias in both the virus library and the functional virus particles.

Figure 14:
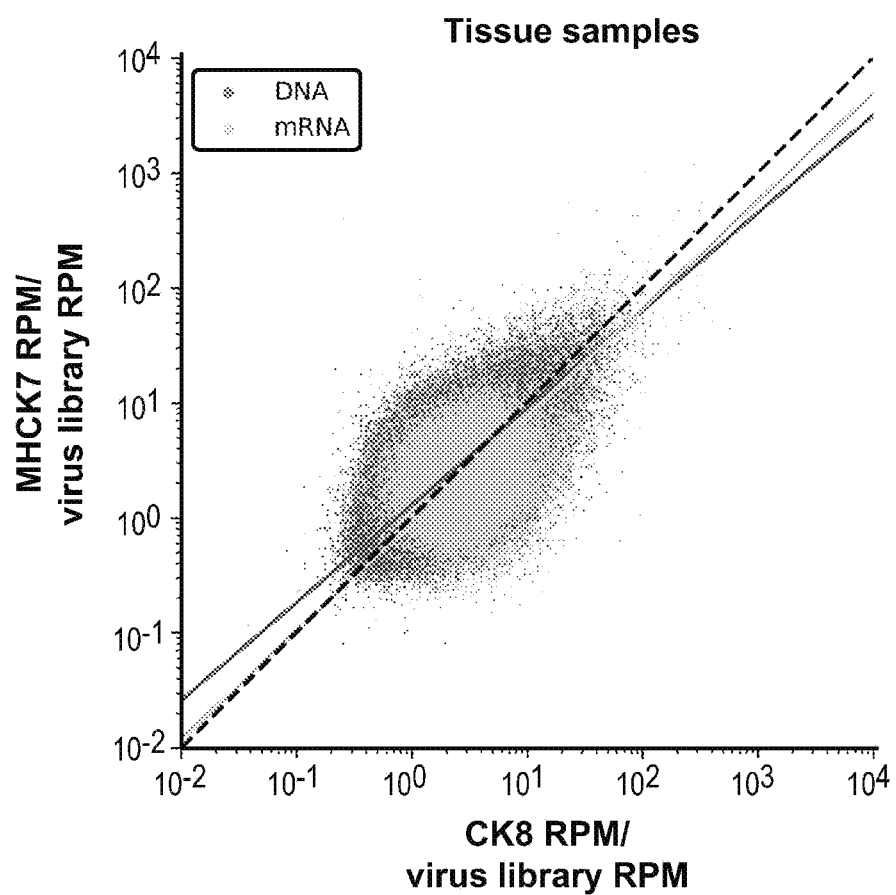
FIG. 14 shows a graph that can demonstrate a correlation between the abundance of the same variants expressed under the control of two different muscle specific promoters (MHCK7 and CK8).

FIG. 14 shows a graph that can demonstrate a correlation between the abundance of the same variants expressed under the control of two different muscle specific promoters (MHCK7 and CK8). This graph can demonstrate that there is little effect of which tissue-specific promoter is used to generate the capsid variant library, at least for muscle cells.

Example 5—Muscle-Tropic rAAV Capsids

Figure 15:
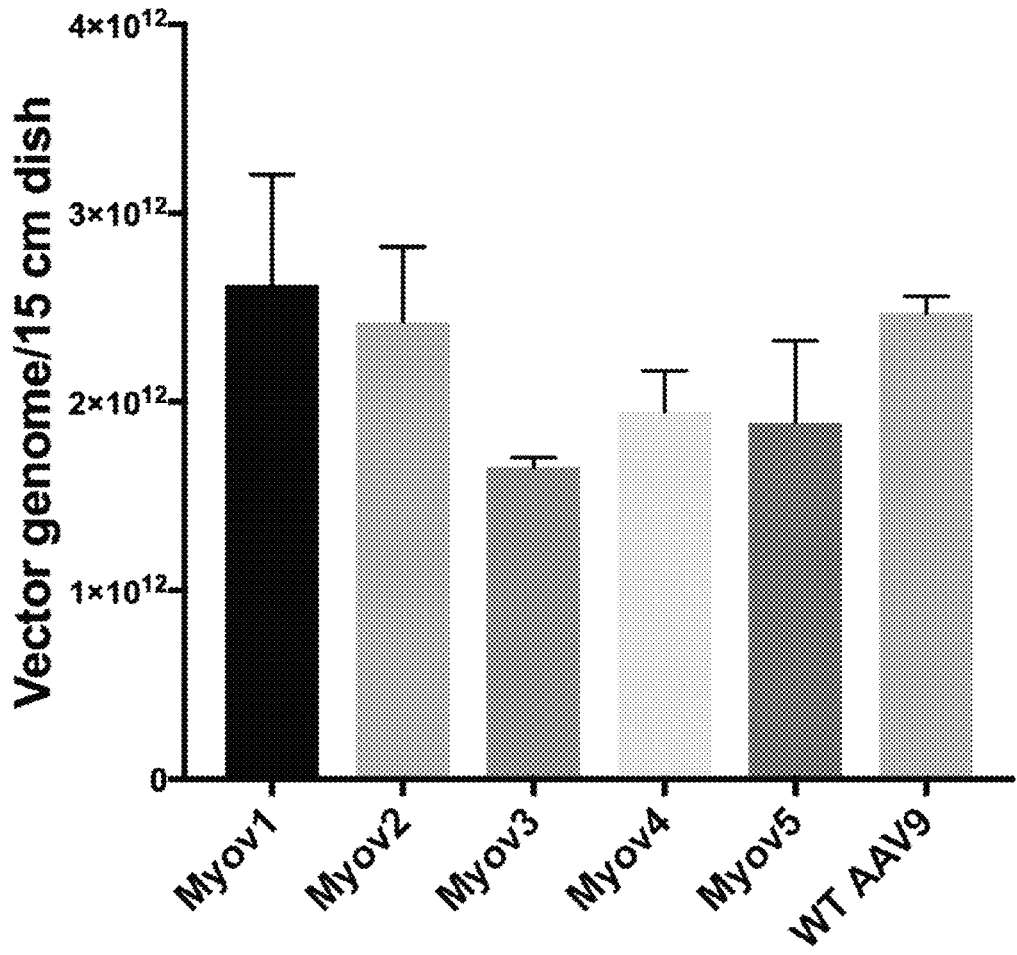
FIG. 15 shows a graph that can demonstrate muscle-tropic capsid variants that produce rAAV with similar titers to wild-type AAV9 capsid.

FIG. 15 shows a graph that can demonstrate muscle-tropic capsid variants that produce rAAV with similar titers to wild-type AAV9 capsid.

Figure 16:
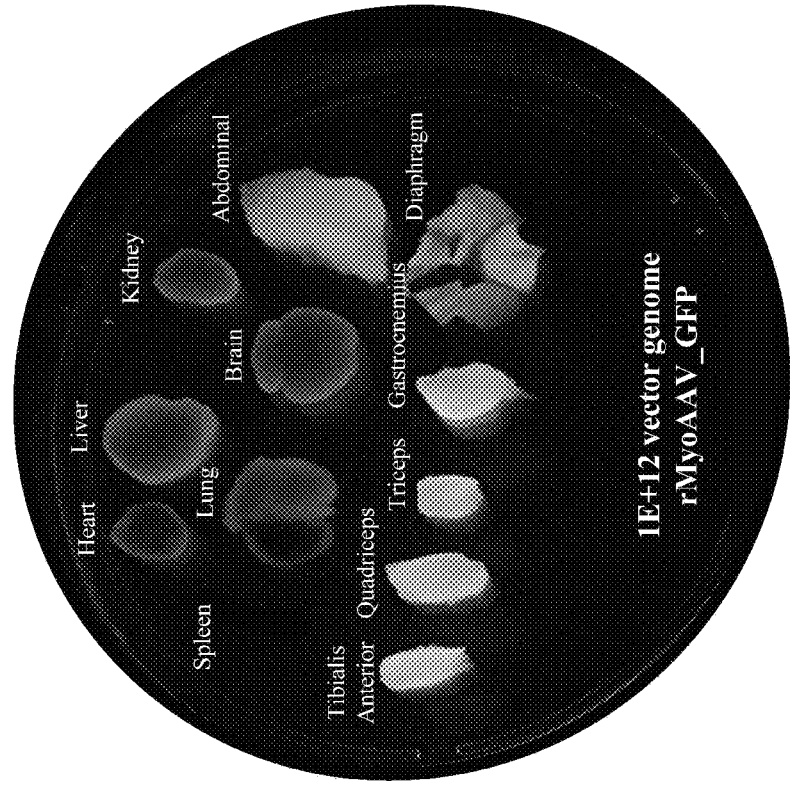
FIG. 16 shows images that can demonstrate a comparison of mouse tissue transduction between rAAV9-GFP and rMyoAAV-GFP.
Figure 16:
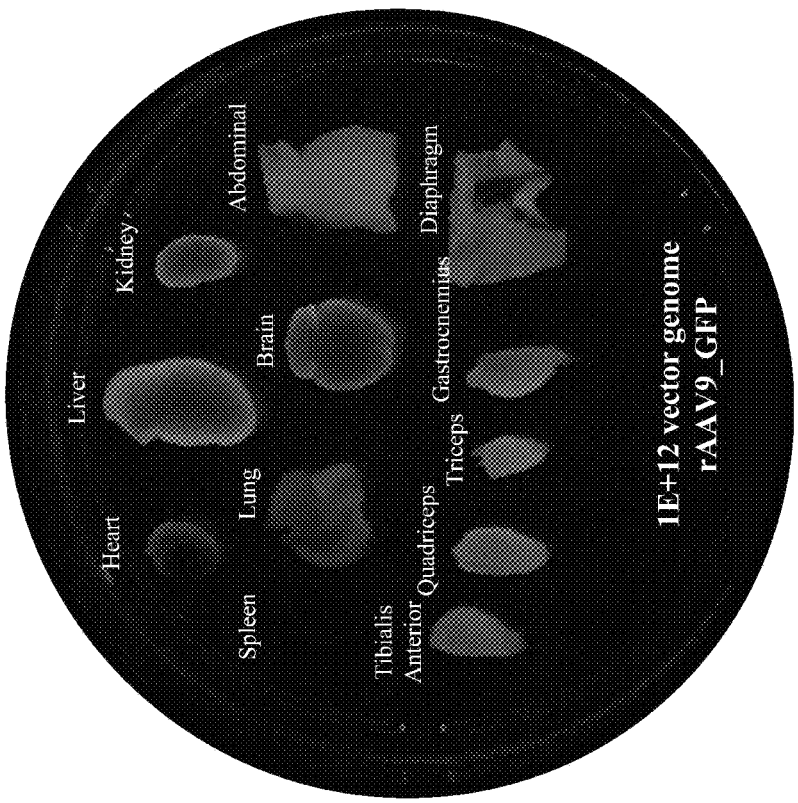

FIG. 16 shows images that can demonstrate a comparison of mouse tissue transduction between rAAV9-GFP and rMyoAAV-GFP.

Figure 17:
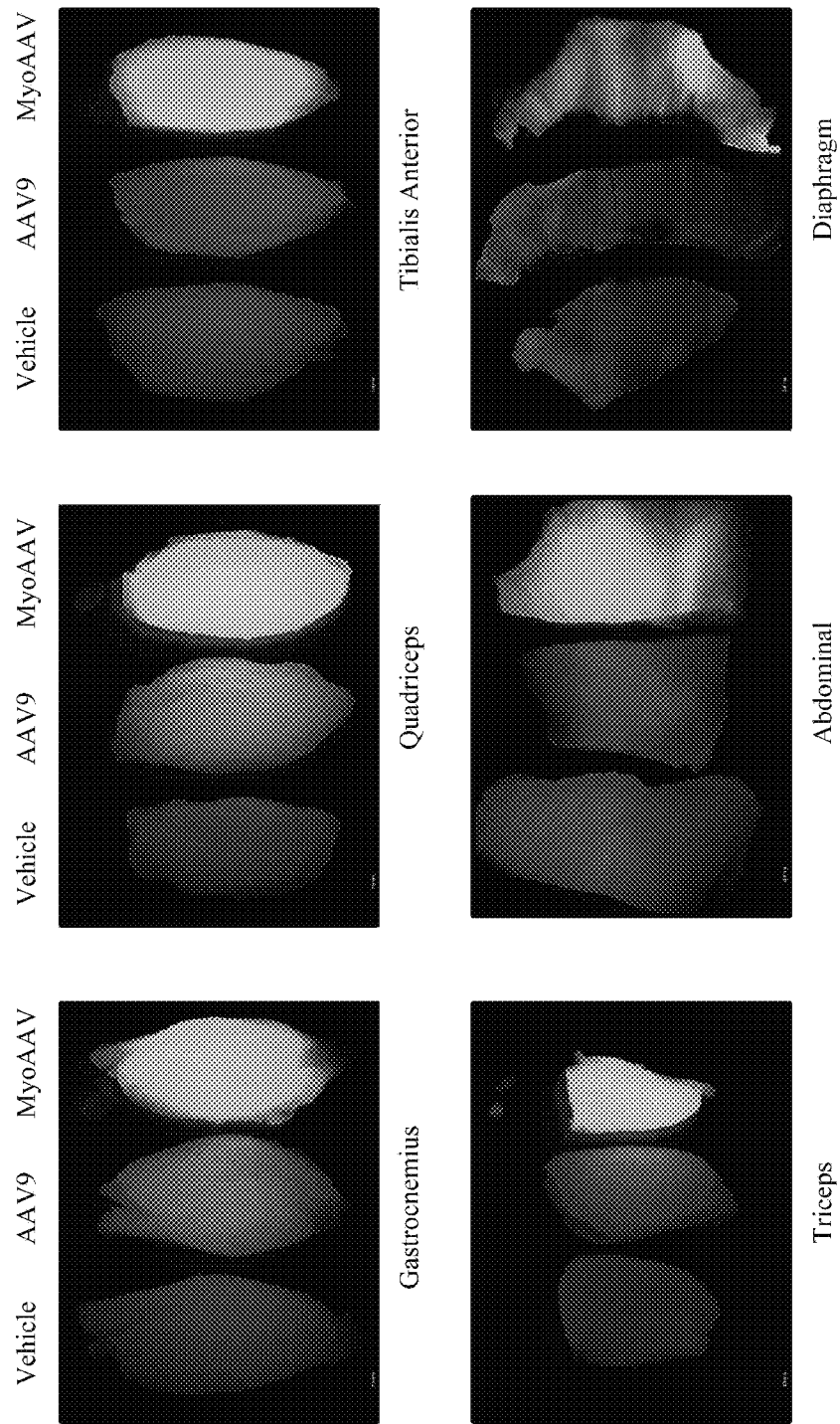
FIG. 17 shows a panel of images that can demonstrate a comparison of mouse tissue transduction between rAAV9-GFP and rMyoAAV-G.

FIG. 17 shows a panel of images that can demonstrate a comparison of mouse tissue transduction between rAAV9-GFP and rMyoAAV-GFP.

Figure 18:
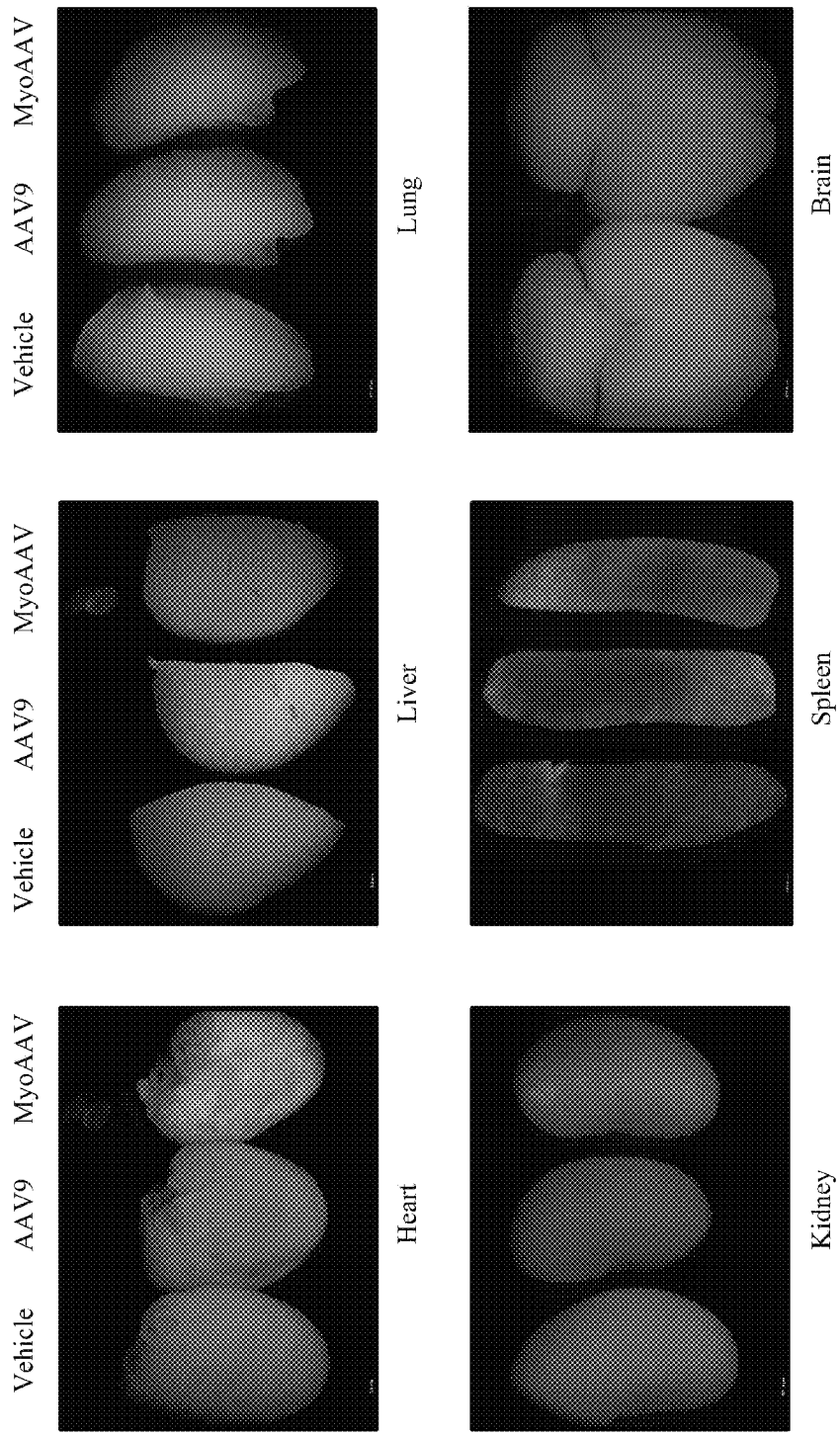
FIG. 18 shows a panel of images that can demonstrate a comparison of mouse tissue transduction between rAAV9-GFP and rMyoAAV-GF.

FIG. 18 shows a panel of images that can demonstrate a comparison of mouse tissue transduction between rAAV9-GFP and rMyoAAV-GFP.

Figure 19:
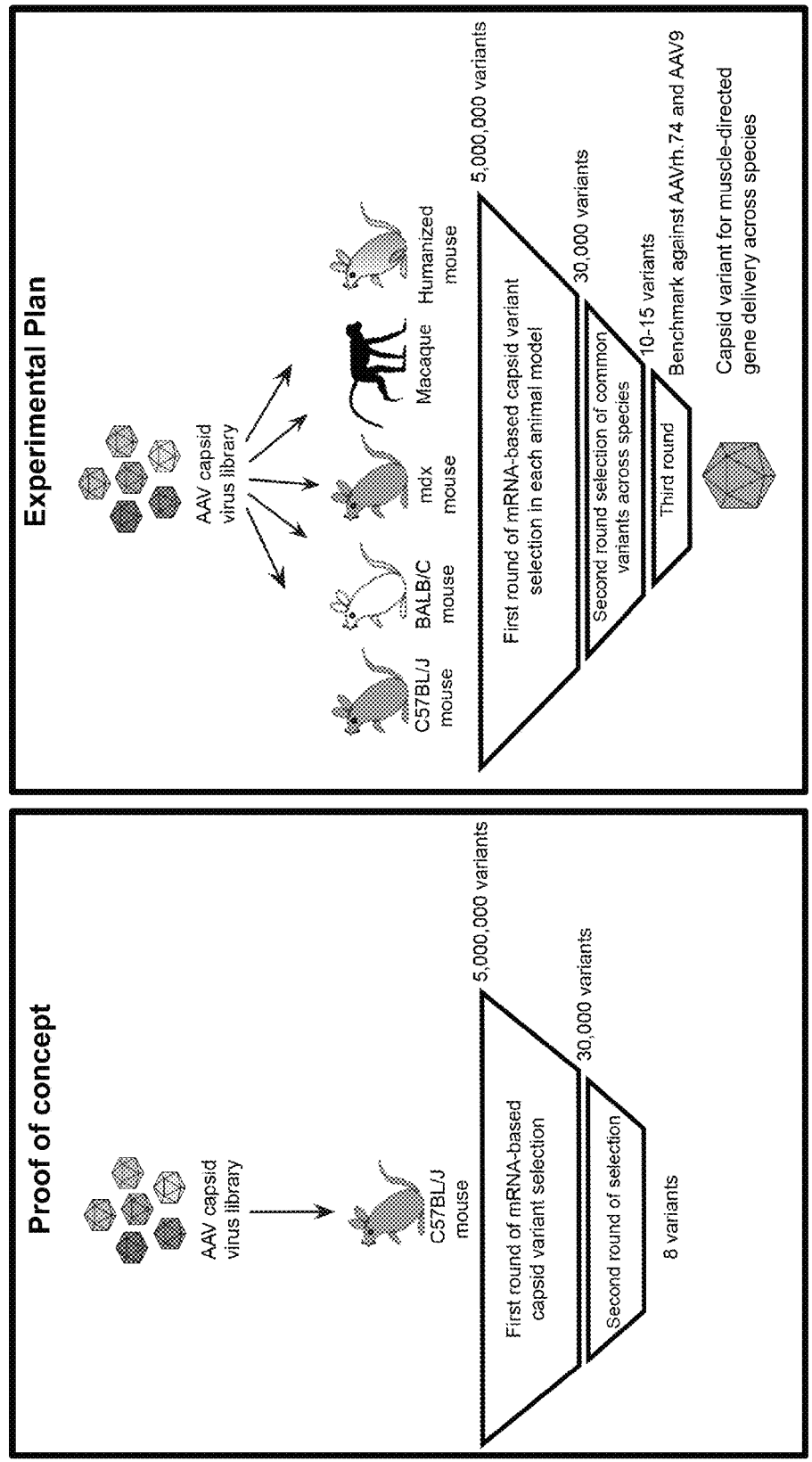
FIG. 19 shows a schematic of selection of potent capsid variants for muscle-directed gene delivery across species.

FIG. 19 shows a schematic of selection of potent capsid variants for muscle-directed gene delivery across species.

FIGS. 20A-20C show tables that can demonstrate selection in different strains of mice identifies the same variants as the top muscle-tropic hits.

Example 6—Comparison of MyoAAV and AAV9 and AAV8

As previously discussed, FIG. 17 can demonstrate a comparison of mouse tissue transduction between rAAV9-GFP and rMyoAAV-GFP.

Figure 21:
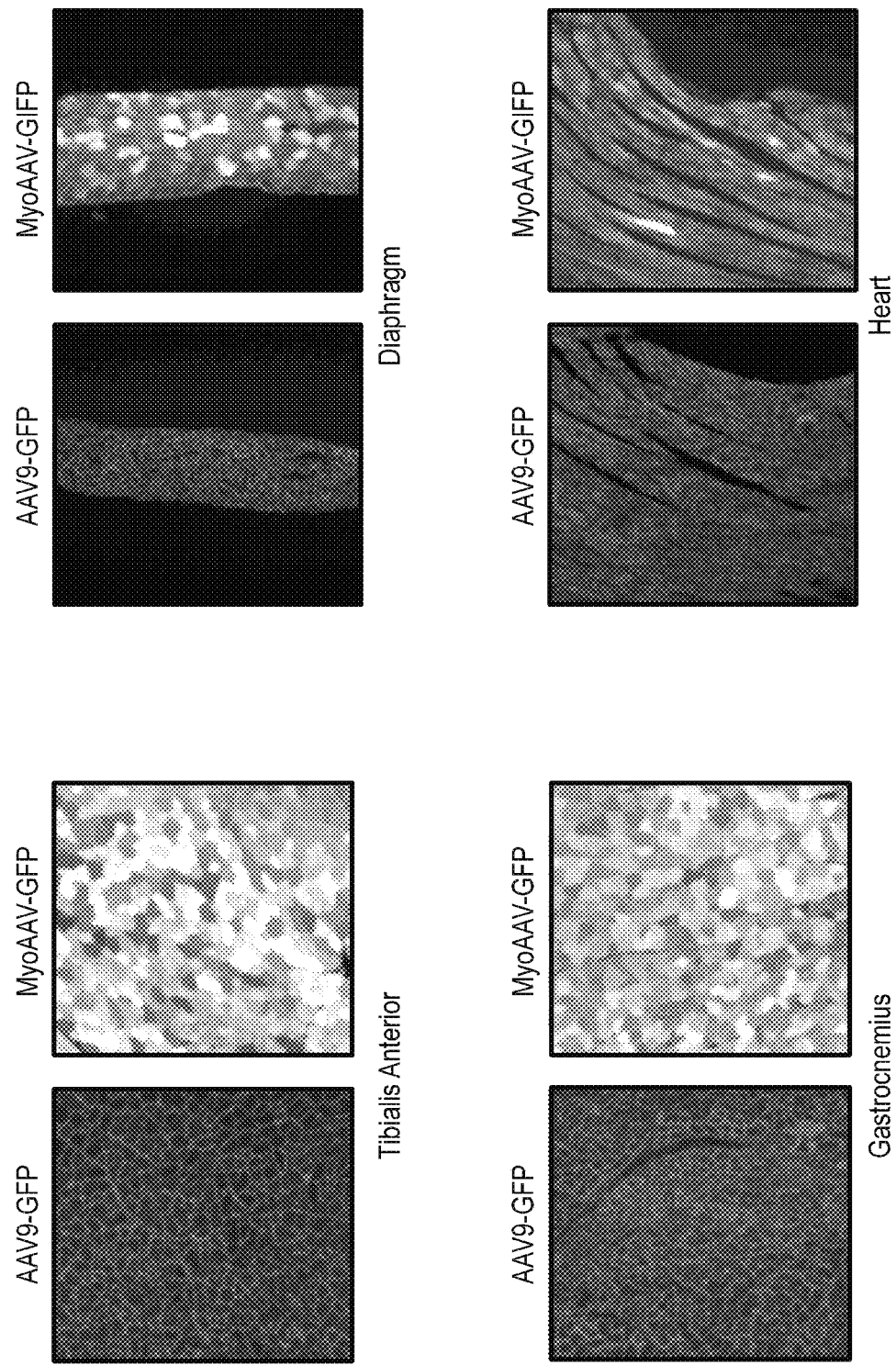
FIG. 21 shows images that can demonstrate a comparison of mouse muscle transduction between rAAV9-GFP and rMyoAAV-GFP.

FIG. 21 shows images that can demonstrate a comparison of mouse muscle transduction between rAAV9-GFP and rMyoAAV-GFP.

Figure 22:
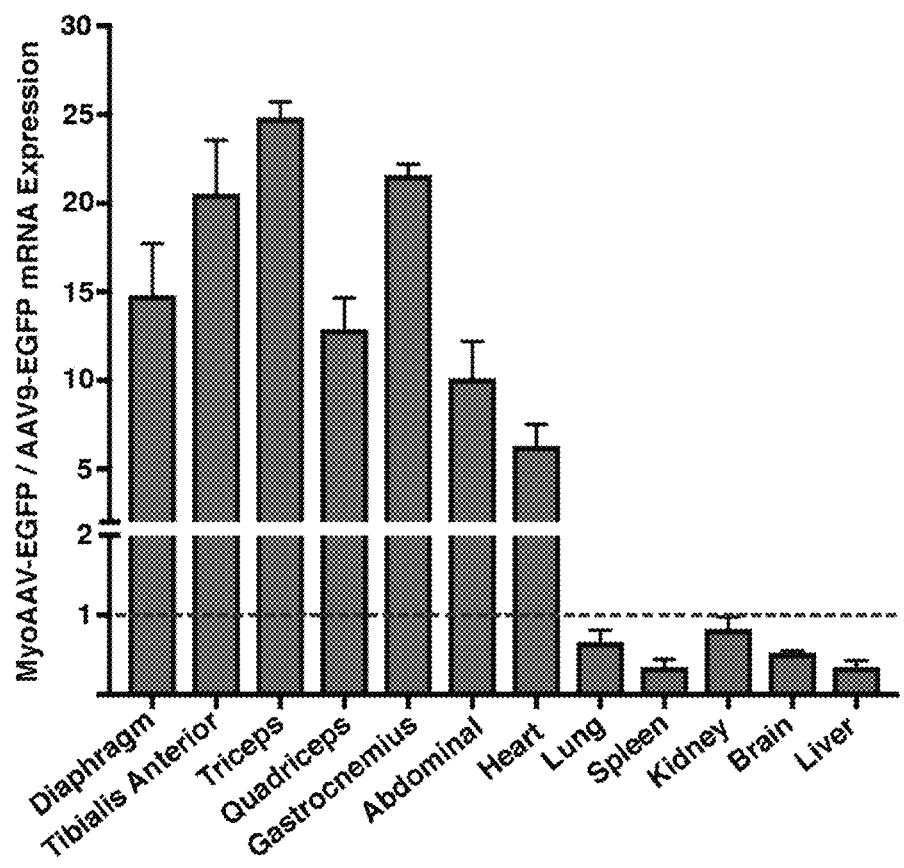
FIG. 22 shows graphs that can demonstrate a comparison of mouse tissue transduction between rAAV9-GFP and rMyoAAV-GFP.

FIG. 22 shows graphs that can demonstrate a comparison of mouse tissue transduction between rAAV9-GFP and rMyoAAV-GFP.

Figure 23:
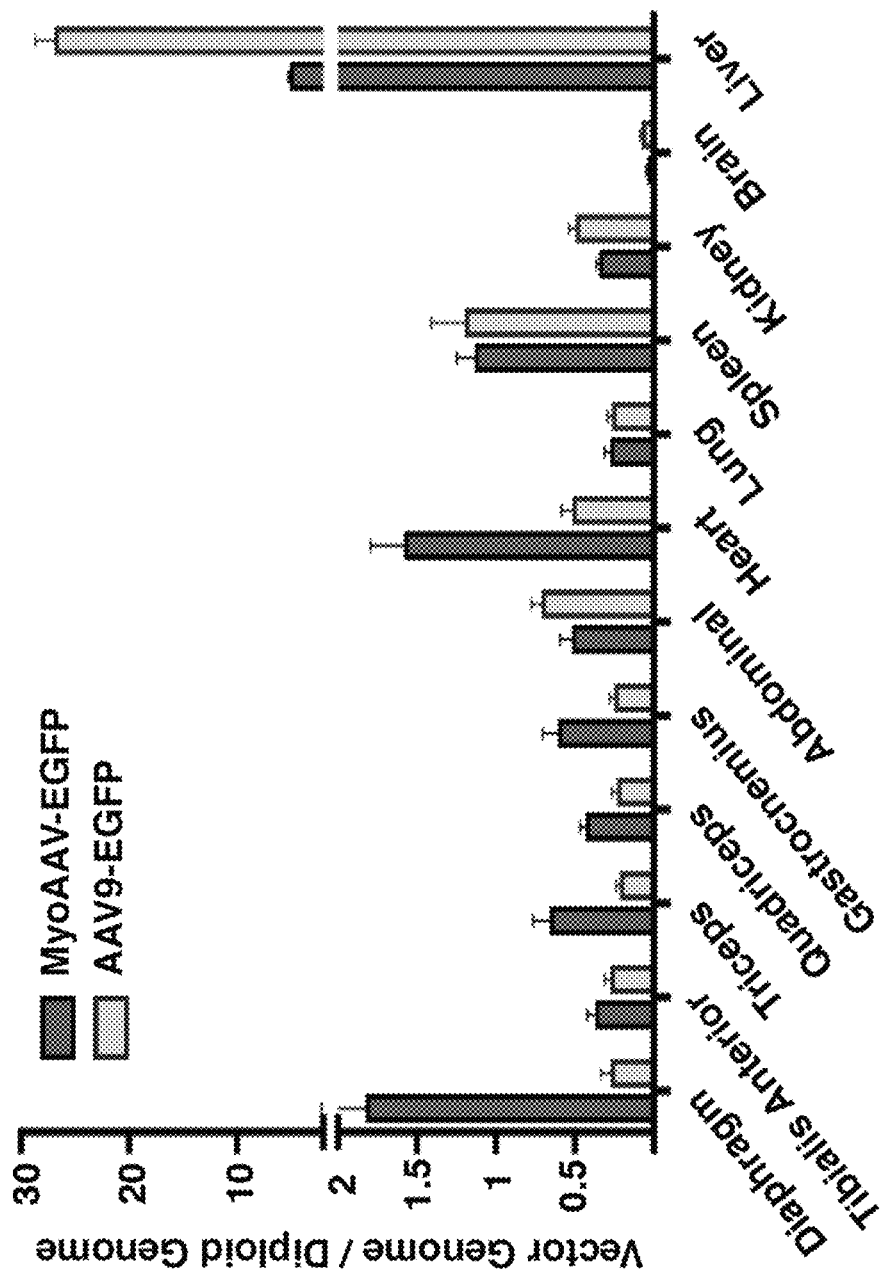
FIG. 23 shows graphs that can demonstrate a comparison of vector genome biodistribution between rAAV9-GFP and rMyoAAV-GFP.

FIG. 23 shows graphs that can demonstrate a comparison of vector genome biodistribution between rAAV9-GFP and rMyoAAV-GFP.

Figure 24A:
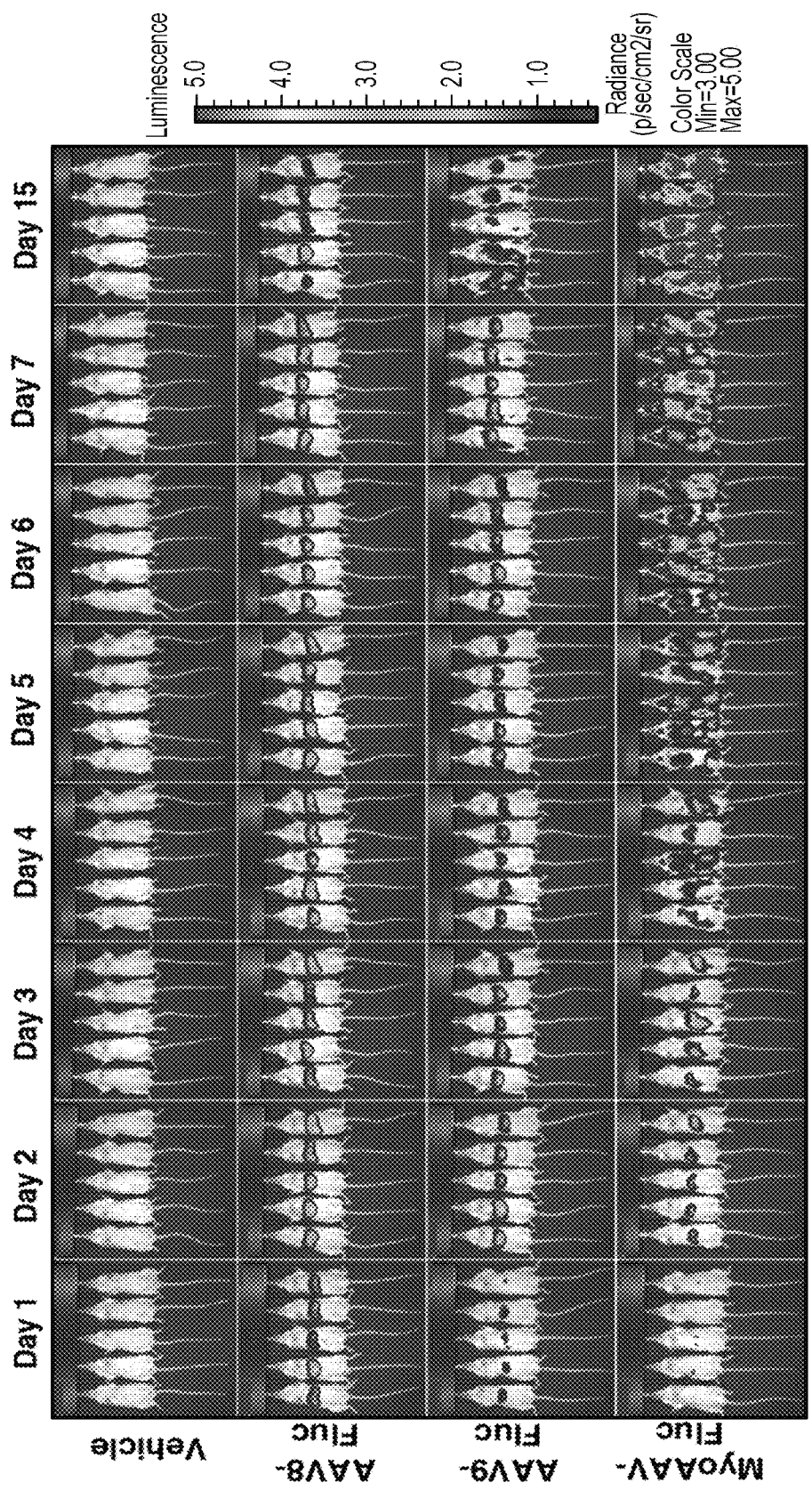
FIGS. 24A-24B show images that can demonstrate faster kinetics of in vivo gene expression in muscle by MyoAAV as compared to AAV9 and AAV8.
Figure 24B:
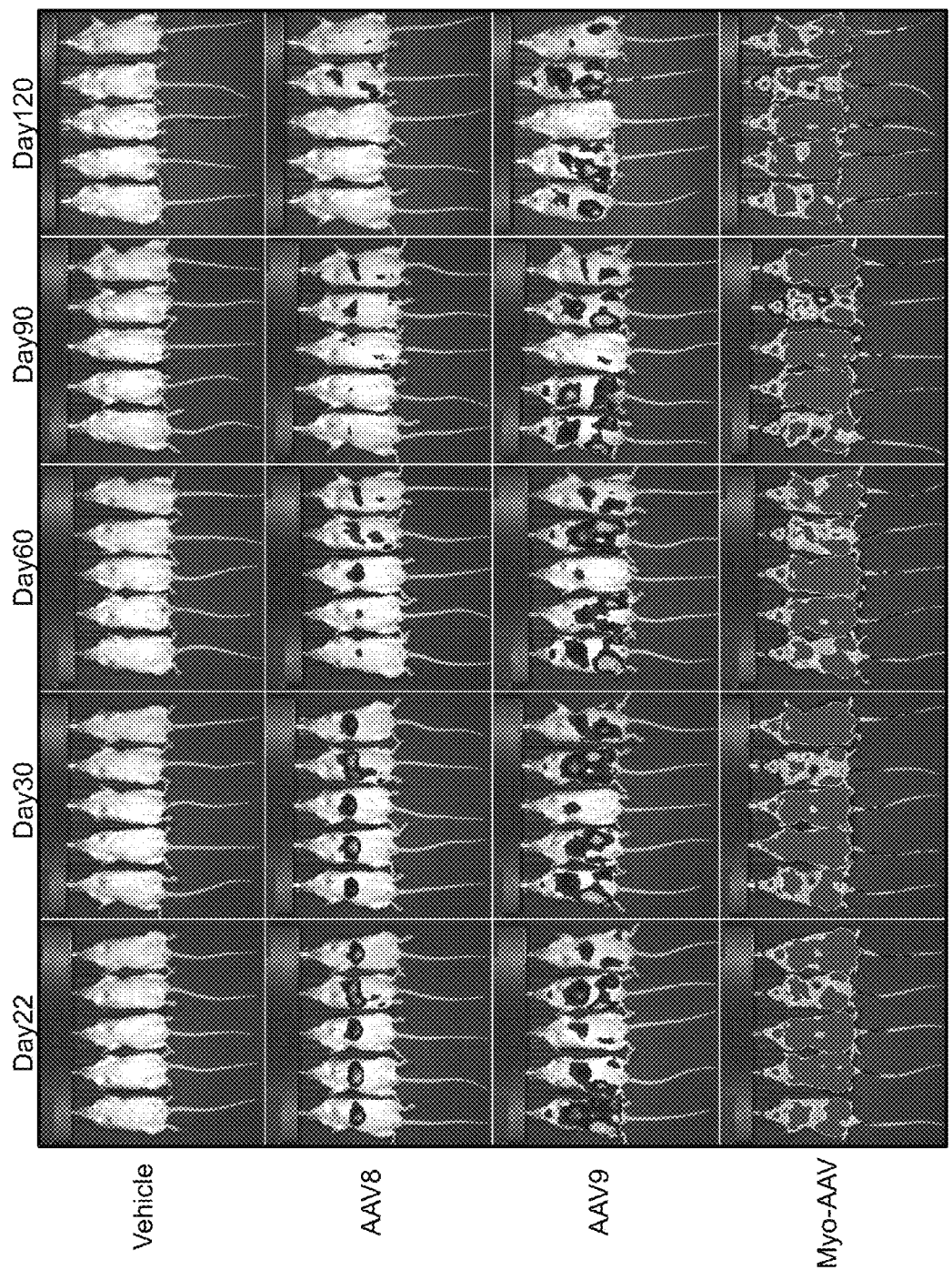

FIGS. 24A-24B show images that can demonstrate faster kinetics of in vivo gene expression in muscle by MyoAAV as compared to AAV9 and AAV8.

Figure 25:
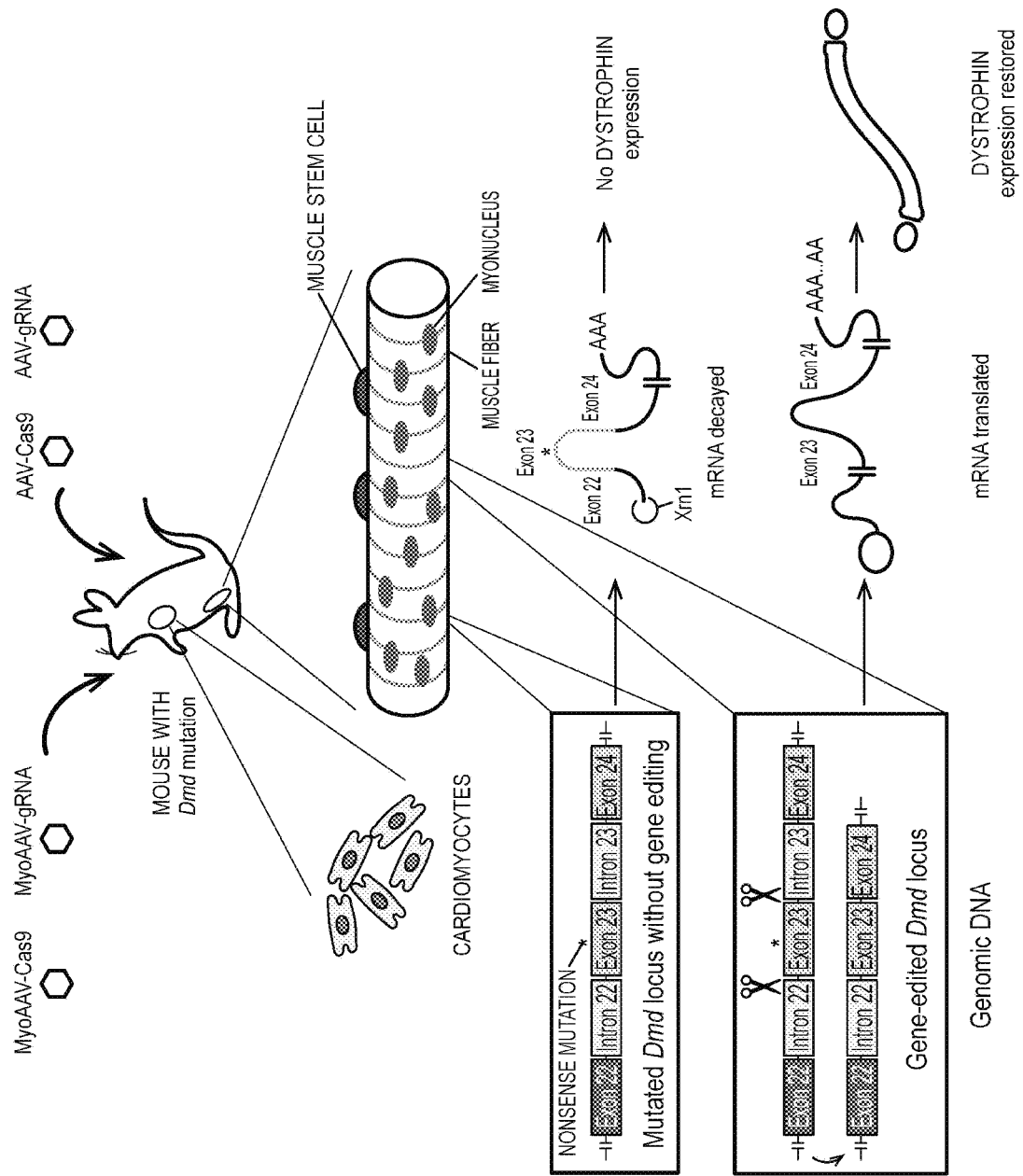
FIG. 25 can demonstrate a mechanism of correction of a DMD mutation in model mdx mice by MyoAAV-CRISPR as compared to AAV9-CRISPR.

FIG. 25 can demonstrate a mechanism of correction of a DMD mutation in model mdx mice by MyoAAV-CRISPR or AAV9-CRISPR.

Figure 26A:
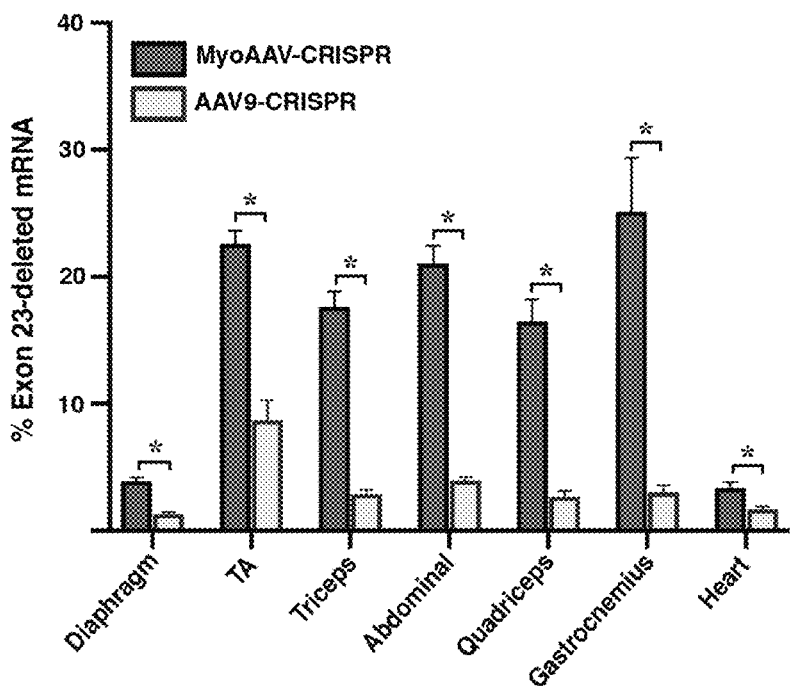
FIGS. 26A-26C can demonstrate correction of a DMD mutation in model mdx mice with MyoAAV-CRISPR as compared to AAV9-CRISPR.
Figure 26B:
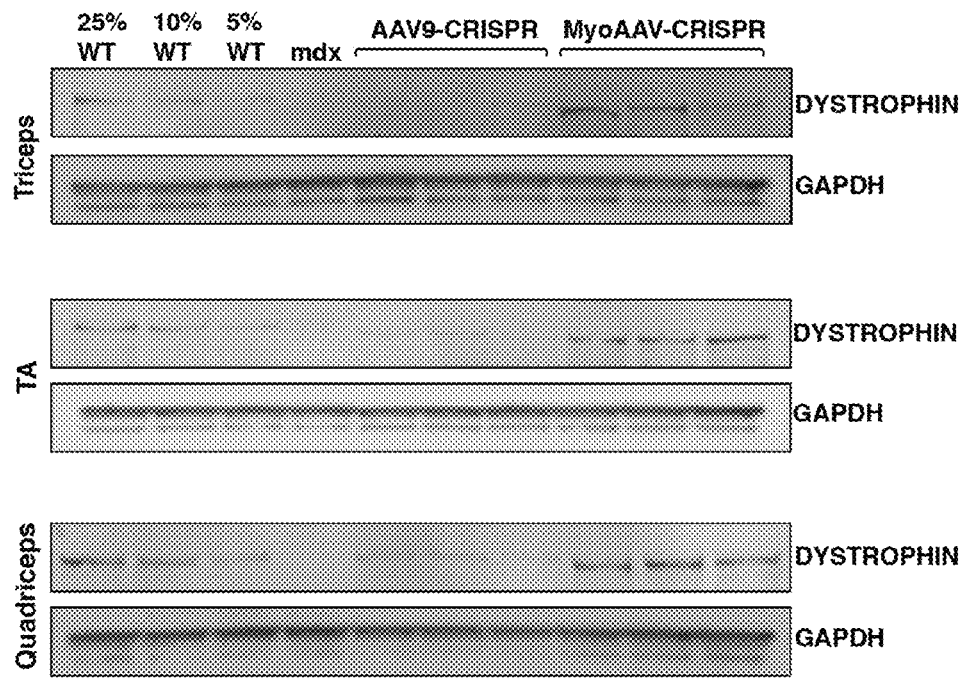
Figure 26C:
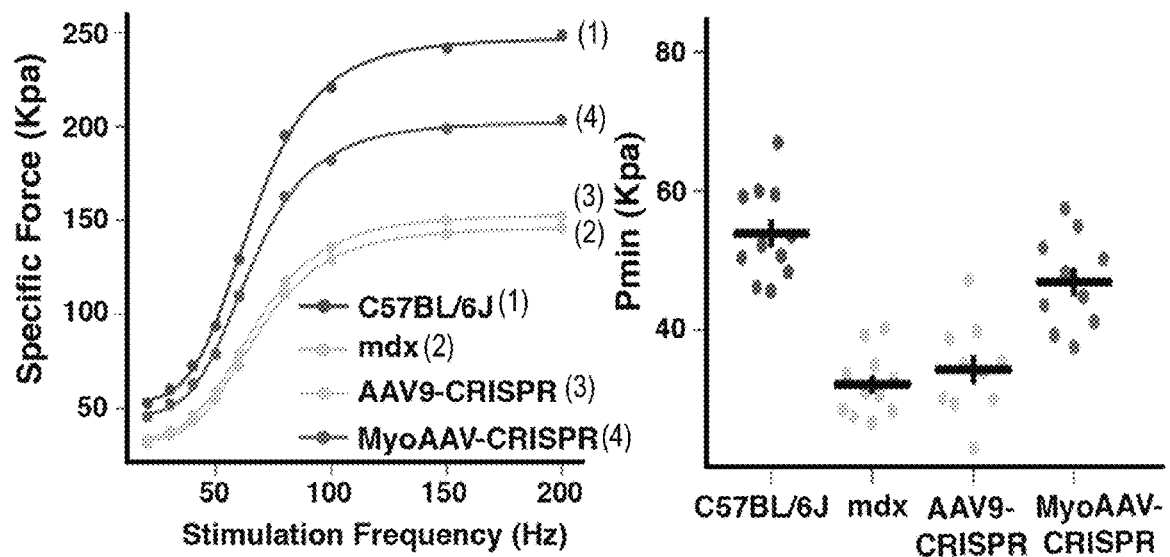
Figure 26C:
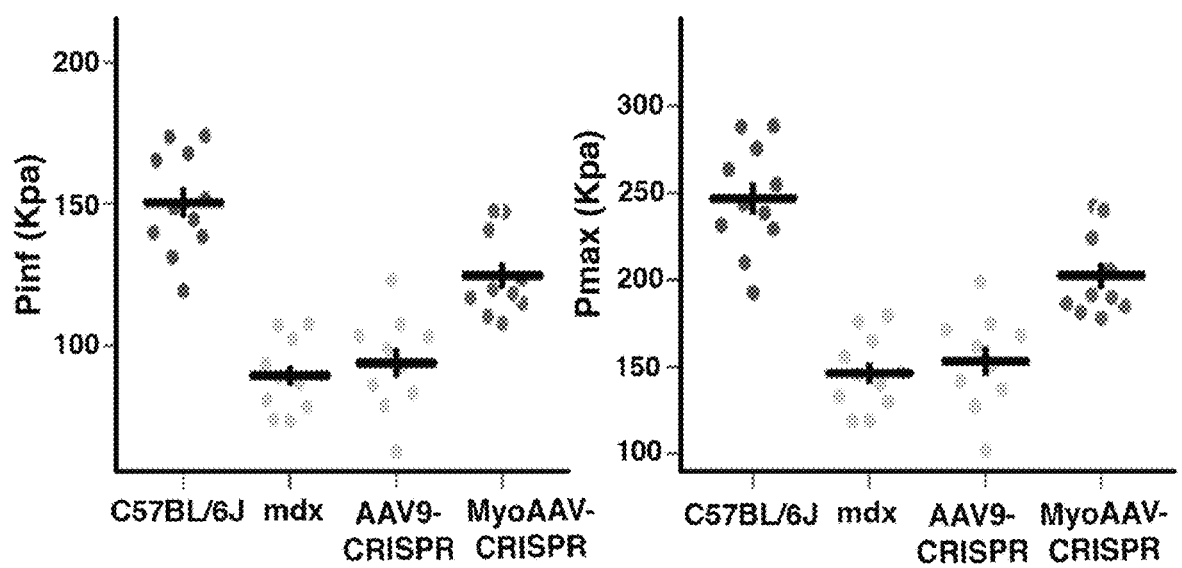

FIGS. 26A-26C can demonstrate correction of a DMD mutation in model mdx mice with MyoAAV-CRISPR as compared to AAV9-CRISPR.

Figure 27:
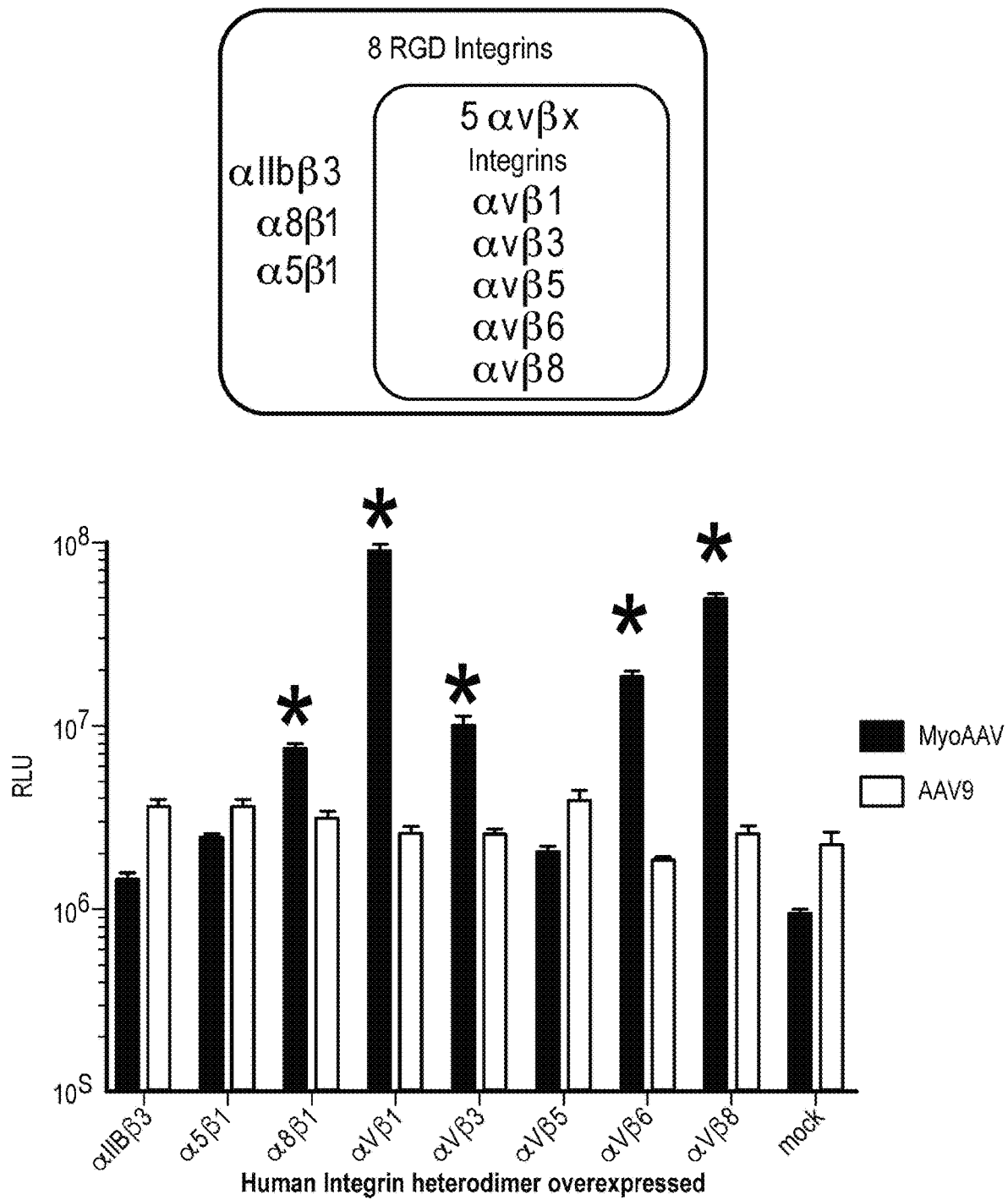
FIG. 27 can demonstrate that MyoAAV uses integrin heterodimers as the receptor to enter cells.

FIG. 27 can demonstrate that MyoAAV uses integrin heterodimers as the receptor to enter cells.

Figure 28:
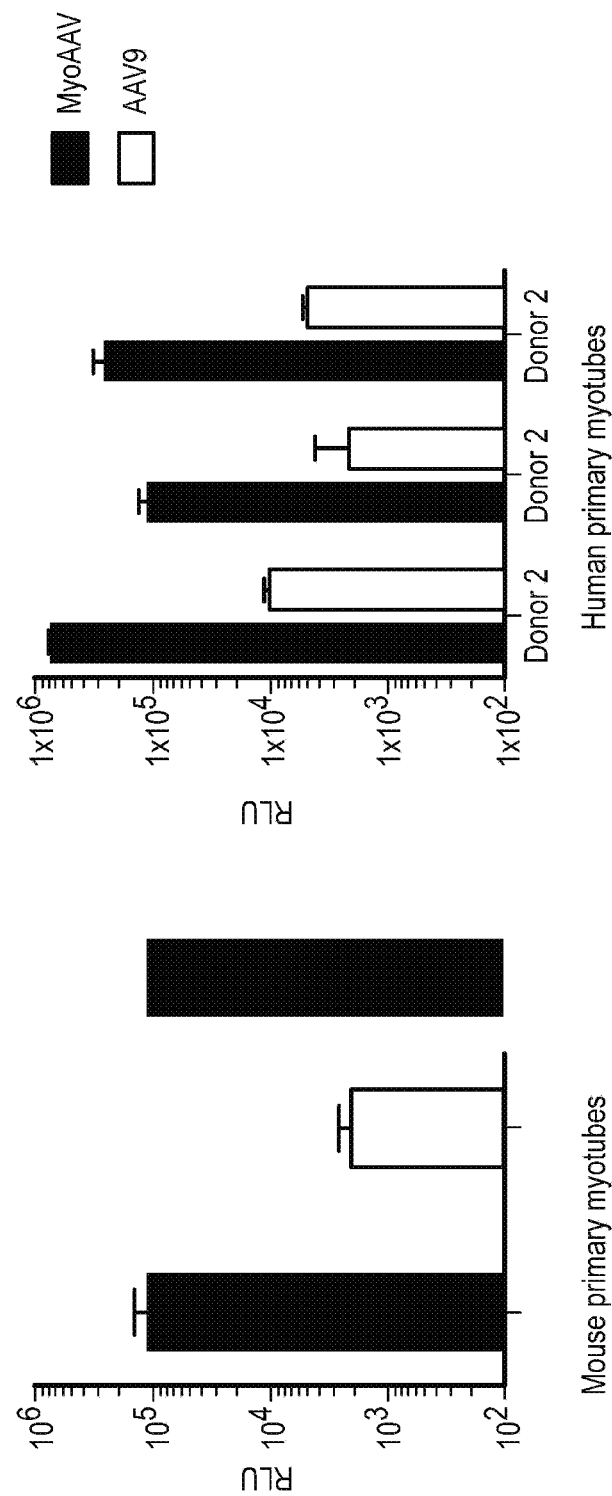
FIG. 28 shows graphs that can demonstrate that myoAAV can transduce both mouse and human primary myotubes 50-100 times more effectively than AAV9.

FIG. 28 shows graphs that can demonstrate that myoAAV can transduce both mouse and human primary myotubes more effectively than AAV9.

Figure 29A:
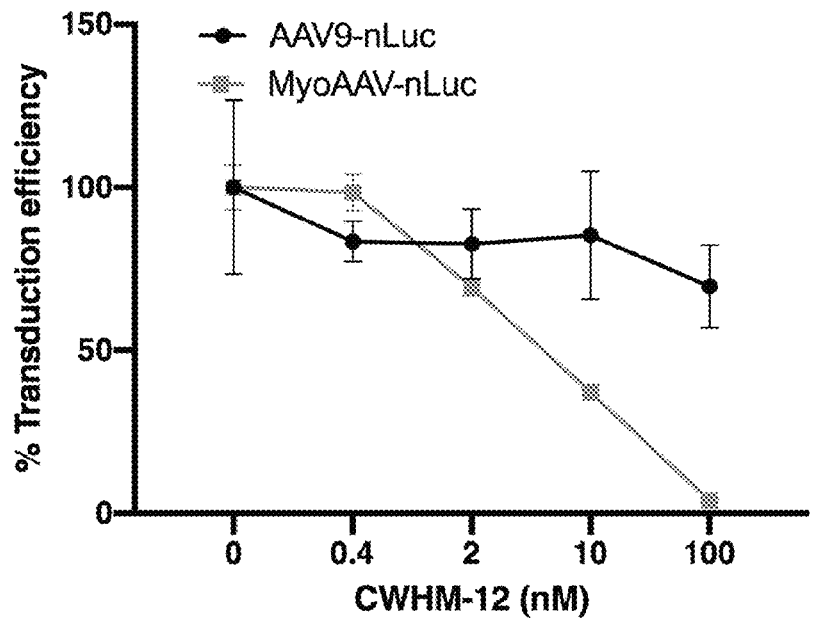
FIGS. 29A-29B can demonstrate that integrin alpha V small molecule inhibitors suppress transduction of human primary myotubes by MyoAAV.
Figure 29A:
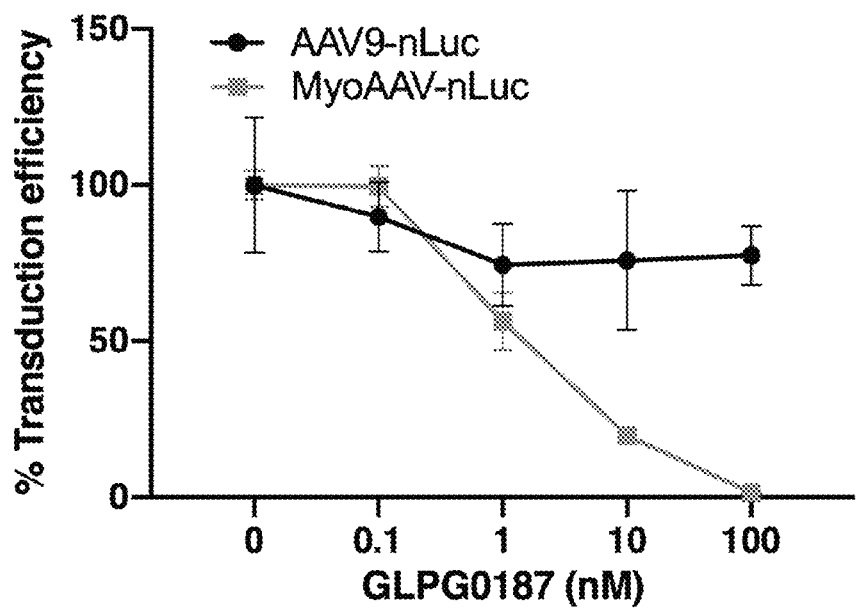
Figure 29B:
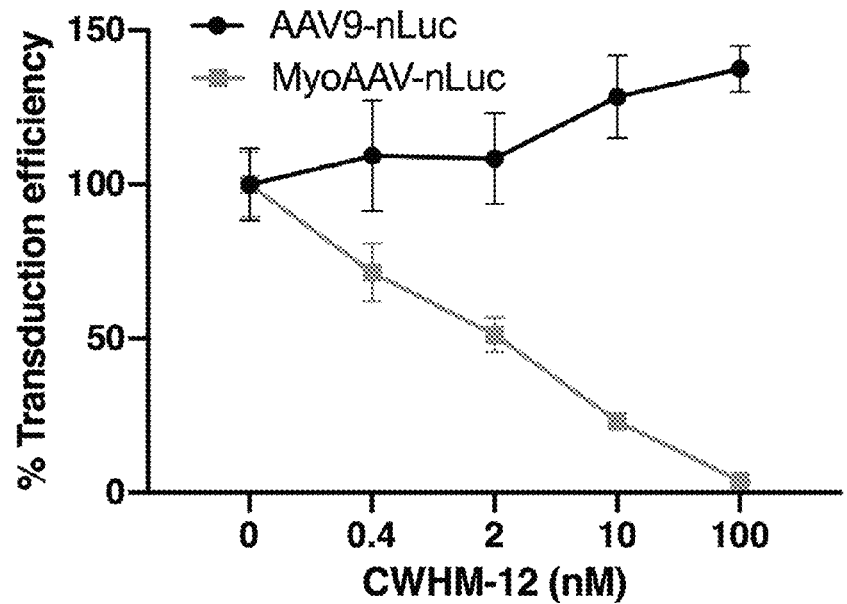
Figure 29B:
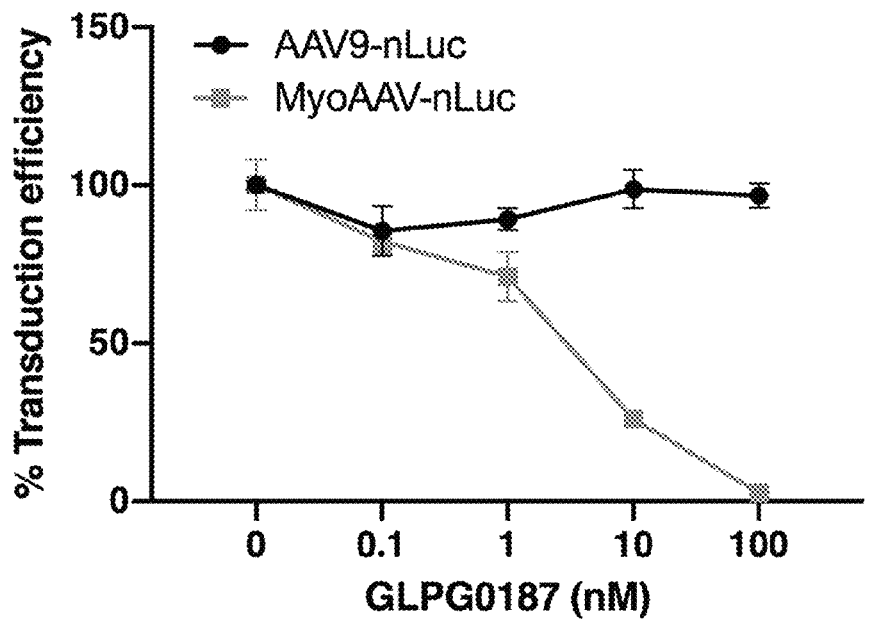

FIGS. 29A-29B can demonstrate that integrin alpha V small molecule inhibitors suppress transduction of human and mouse primary myotubes by MyoAAV.

Example 7-Top n-Mer Motifs in Non-Human Primates

Muscle specific AAV capsids were developed using a muscle specific promoter and the resulting capsid libraries were screened in non-human primates as described elsewhere herein and/or in U.S. Provisional Application Ser. Nos. 62/899,453, 62/916,207, 63/018,454, 63/055,252, and 62/916,221 and International Application No. PCT/US20/50534. Tables 8 and 9 show the top hits of muscle specific n-mer motifs and their encoding sequence in rank order within each table.

TABLE 8

| N-Mer Motif | SEQ ID NO: | Encoding Sequence | score | SEQ ID NO: |
|---|---|---|---|---|
| RGDYHAI | 8314 | AGGGGCGACTACCACGCCATC | 4178 | 8503 |
| RGDYASL | 8315 | CGGGGCGACTACGCAAGCCTG | 3851 | 8504 |
| RGDYVGL | 8316 | CGGGGTGATTATGTGGGGCTG | 3686 | 8505 |
| RGDLRPT | 8317 | CGTGGGGATCTTAGGCCGACG | 3610 | 8506 |
| RGDHVSL | 8318 | CGTGGGGATCATGTGTCTTTG | 3050 | 8507 |
| DVRSLHG | 8319 | GACGTTAGATCCCTTCACGGC | 2985 | 8508 |
| RGDYHAI | 8320 | CGTGGTGATTATCATGCTATT | 2944 | 8509 |
| RGDYGGL | 8321 | CGTGGTGATTATGGTGGGCTG | 2816 | 8510 |
| RGDHGVL | 8322 | CGGGGTGATCATGGGGTTCTT | 2692 | 8511 |
| RGDYREL | 8323 | AGAGGAGACTACCGGGAACTC | 2690 | 8512 |
| VSRGDVP | 8324 | GTTAGTCGGGGTGATGTGCCT | 2675 | 8513 |
| RGDYVGL | 8325 | CGCGGGGACTACGTAGGTTTA | 2666 | 8514 |
| RGDYSGL | 8326 | CGGGGTGATTATTCGGGGTTG | 2642 | 8515 |
| RGDLTVT | 8327 | AGGGGGGACCTGACAGTCACG | 2604 | 8516 |
| RGDHASW | 8328 | CGTGGTGATCATGCTTCTTGG | 2603 | 8517 |
| RGDLVGY | 8329 | AGGGGGGATCTTGTGGGGTAT | 2543 | 8518 |
| RGDGAAM | 8330 | CGTGGGGATGGTGCGGCGATG | 2439 | 8519 |
| VSAARSL | 8331 | GTGAGTGCGGCGCGTTCTCTG | 2437 | 8520 |
| LTAQYVT | 8332 | TTGACTGCTCAGTATGTGACG | 2430 | 8521 |
| RGDHGVL | 8333 | CGCGGAGACCACGGTGTATTA | 2429 | 8522 |
| VGNRFSP | 8334 | GTTGGGAATAGGTTTTCGCCG | 2410 | 8523 |
| TGVHTRV | 8335 | ACGGGTGTTCATACGAGGGTG | 2405 | 8524 |
| VRTGDAS | 8336 | GTGCGTACTGGTGATGCGTCG | 2401 | 8525 |
| MVVRGGV | 8337 | ATGGTGGTGCGTGGGGGTGTT | 2393 | 8526 |
| RGDRESH | 8338 | CGCGGAGACCGAGAAAGCCAC | 2370 | 8527 |
| RGDYSGL | 8339 | CGTGGCGACTACTCTGGTCTA | 2306 | 8528 |
| RGDLSSV | 8340 | CGGGGTGATCTTTCGAGTGTT | 2292 | 8529 |
| LLGQRAA | 8341 | CTGCTTGGTCAGAGGGCTGCT | 2269 | 8530 |

TABLE 8-continued

| N-Mer Motif | SEQ ID NO: | Encoding Sequence | score | SEQ ID NO: |
|---|---|---|---|---|
| GKGTVPS | 8342 | GGGAAGGGGACTGTGCCGAGT | 2262 | 8531 |
| SSIGVKI | 8343 | TCGTCGATTGGTGTGAAGATT | 2256 | 8532 |
| ANKGLGT | 8344 | GCAAACAAAGGCCTGGGCACG | 2246 | 8533 |
| RGDHASW | 8345 | CGGGGGGATCATGCTTCTTGG | 2245 | 8534 |
| RGDRLVI | 8346 | AGAGGAGACAGGCTGGTCATC | 2219 | 8535 |
| GQGHRGD | 8347 | GGACAAGGCCACCGGGGAGAC | 2215 | 8536 |
| ERTRAGE | 8348 | GAGAGGACTCGGGCGGGTGAG | 2209 | 8537 |
| RGDLSGT | 8349 | AGGGGCGACCTGTCTGGCACC | 2203 | 8538 |
| RGDYREM | 8350 | CGGGGGGATTATCGTGAGATG | 2201 | 8539 |
| RGDLAHN | 8351 | AGGGGTGATCTTGCGCATAAT | 2183 | 8540 |
| GFSGRTV | 8352 | GGGTTTAGTGGGAGGACGGTG | 2183 | 8541 |
| VMRAGAT | 8353 | GTTATGCGAGCAGGTGCGACG | 2173 | 8542 |
| EGGIYRV | 8354 | GAAGGAGGAATCTACCGTGTT | 2168 | 8543 |
| RGDYREL | 8355 | CGTGGTGATTATCGTGAGTTG | 2168 | 8544 |
| QSVSIKS | 8356 | CAGAGTGTGTCTATTAAGTCT | 2167 | 8545 |
| RGDLVHV | 8357 | CGAGGAGACTTGGTCCACGTC | 2161 | 8546 |
| YRGDIRV | 8358 | TACCGTGGTGACATACGGGTG | 2156 | 8547 |
| RGDASTW | 8359 | CGTGGGGACGCCAGTACCTGG | 2148 | 8548 |
| RGDYGGI | 8360 | CGTGGGGATTATGGTGGTATT | 2146 | 8549 |
| VGTRGDT | 8361 | GTGGGTACGCGGGGGGATACG | 2146 | 8550 |
| RGDLTTV | 8362 | CGGGGGGATCTGACGACTGTT | 2133 | 8551 |
| RGDMRPV | 8363 | CGTGGTGATATGCGTCCGGTT | 2126 | 8552 |
| AAGRLTT | 8364 | GCTGCTGGTAGGCTTACGACG | 2125 | 8553 |
| NAGRSTL | 8365 | AACGCAGGGCGCTCTACCTTA | 2108 | 8554 |
| ERDRISG | 8366 | GAGCGGGATCGGATTTCGGGT | 2091 | 8555 |
| RGDLTTT | 8367 | CGGGGTGACCTGACAACCACG | 2082 | 8556 |
| TTGLRLA | 8368 | ACGACTGGGCTTCGTCTGGCT | 2082 | 8557 |
| RGDHSGW | 8369 | CGTGGTGATCATAGTGGTTGG | 2080 | 8558 |
| SGGTYLA | 8370 | AGCGGGGGAACGTACCTTGCC | 2078 | 8559 |
| AVVRGGP | 8371 | GCTGTTGTGCGGGGTGGTCCT | 2064 | 8560 |
| IVRGLSD | 8372 | ATTGTGAGGGGTCTGAGTGAT | 2054 | 8561 |
| RGDTMRL | 8373 | CGCGGAGACACGATGAGACTG | 2054 | 8562 |
| TRVPVSG | 8374 | ACGCGAGTACCGGTGAGCGGG | 2052 | 8563 |
| RTYDSNV | 8375 | CGAACGTACGACTCAAACGTA | 2052 | 8564 |
| RGDRMGV | 8376 | CGGGGTGATCGTATGGGTGTG | 2043 | 8565 |
| QLNAYSG | 8377 | CAGTTGAATGCGTATAGTGGG | 2042 | 8566 |
| SLGITSG | 8378 | TCATTGGGTATAACCTCGGGC | 2040 | 8567 |
| TAAVRTY | 8379 | ACGGCTGCGGTGCGTACGTAT | 2031 | 8568 |

TABLE 8-continued

| N-Mer Motif | SEQ ID NO: | Encoding Sequence | score | SEQ ID NO: |
|---|---|---|---|---|
| RGDLTTT | 8380 | CGTGGGGATCTTACTACGACT | 2031 | 8569 |
| RGDYATF | 8381 | CGGGGTGATTATGCTACTTTT | 2028 | 8570 |
| RGDIVGL | 8382 | AGGGGTGACATAGTGGGCCTC | 2027 | 8571 |
| GSRGDLS | 8383 | GGTAGTCGTGGCGACTTATCG | 2027 | 8572 |
| RGDVTHI | 8384 | AGAGGAGACGTTACGCACATC | 2024 | 8573 |
| IGGTRVQ | 8385 | ATTGGTGGGACTCGGGTGCAG | 2023 | 8574 |
| ENHTHRA | 8386 | GAGAATCATACTCATAGGGCT | 2023 | 8575 |
| RGDLTYA | 8387 | CGTGGTGATCTGACGTATGCT | 2022 | 8576 |
| LLHESRV | 8388 | TTGTTGCATGAGTCGCGGGTT | 2021 | 8577 |
| RGDVSGI | 8389 | CGTGGTGATGTTAGTGGGATT | 2018 | 8578 |
| LNSAMRT | 8390 | CTGAATTCTGCGATGCGTACT | 2015 | 8579 |
| RGDYATL | 8391 | AGGGGGGACTACGCCACACTG | 2010 | 8580 |
| SANVVRG | 8392 | TCTGCGAATGTTGTGAGGGGG | 2010 | 8581 |
| VAGQRSV | 8393 | GTTGCTGGGCAGCGTTCTGTT | 2008 | 8582 |
| RGDREHF | 8394 | CGTGGTGATAGGGAGCATTTT | 2007 | 8583 |
| RGDYVTI | 8395 | CGCGGAGACTACGTTACAATA | 1999 | 8584 |
| RLVSTAP | 8396 | CGTCTTGTTTCGACTGCTCCG | 1998 | 8585 |
| HQSFHGA | 8397 | CACCAATCATTCCACGGCGCA | 1996 | 8586 |
| VRGDSRF | 8398 | GTAAGGGGCGACAGCAGATTC | 1991 | 8587 |
| RGDFGGV | 8399 | AGGGGTGACTTCGGAGGTGTC | 1990 | 8588 |
| LVRTTVS | 8400 | CTTGTCAGAACTACAGTGTCC | 1989 | 8589 |
| RGDYVSV | 8401 | CGTGGGGATTATGTGTCTGTG | 1989 | 8590 |
| RGDYASL | 8402 | AGGGGTGATTATGCGTCTCTT | 1983 | 8591 |
| IVRDGRL | 8403 | ATCGTCCGAGACGGAAGACTT | 1978 | 8592 |
| LTHGMIG | 8404 | CTGACGCATGGTATGATTGGT | 1973 | 8593 |
| RGDVRVI | 8405 | CGAGGCGACGTTCGGGTCATA | 1964 | 8594 |
| KAQPSSS | 8406 | AAGGCTCAGCCGTCTTCGTCT | 1964 | 8595 |
| GMRGASV | 8407 | GGGATGAGGGGTGCTTCGGTG | 1961 | 8596 |
| AAGRVGT | 8408 | GCTGCGGGTAGGGTTGGGACG | 1955 | 8597 |
| QMGRVQV | 8409 | CAGATGGGTCGGGTTCAGGTG | 1954 | 8598 |
| LMSRGDT | 8410 | TTGATGTCGCGGGGTGATACT | 1953 | 8599 |
| VHSRGDM | 8411 | GTCCACTCTCGCGGAGACATG | 1952 | 8600 |
| RGDLVTV | 8412 | CGGGGGGATCTGGTTACGGTT | 1952 | 8601 |
| RNYGDHS | 8413 | AGAAACTACGGCGACCACTCG | 1951 | 8602 |
| RGDYSQI | 8414 | AGAGGCGACTACAGCCAAATA | 1950 | 8603 |
| RGDLANS | 8415 | AGGGGTGATTTGGCTAATTCT | 1945 | 8604 |
| RSSHLDV | 8416 | CGTTCCAGTCACCTTGACGTT | 1940 | 8605 |
| RSGTVGL | 8417 | CGCTCCGGGACCGTTGGACTG | 1939 | 8606 |
| IGARGDT | 8418 | ATAGGAGCGAGGGGGACACG | 1938 | 8607 |
| SNAVPGT | 8419 | TCGAATGCGGTTCCTGGTACT | 1935 | 8608 |
| LDARGHL | 8420 | TTGGATGCTAGGGGGCATCTG | 1930 | 8609 |
| TSVSVKY | 8421 | ACTTCTGTGTCGGTGAAGTAT | 1928 | 8610 |
| TRVMGAT | 8422 | ACGCGGGTGATGGGGCGACT | 1920 | 8611 |
| RGGTGVN | 8423 | CGAGGCGGGACTGGAGTAAAC | 1919 | 8612 |
| VASRTSV | 8424 | GTGGCTAGTCGTACGTCTGTT | 1918 | 8613 |
| RGDRLQI | 8425 | CGTGGTGATCGGCTTCAGATT | 1917 | 8614 |
| RGDYERL | 8426 | CGCGGTGACTACGAACGACTA | 1916 | 8615 |
| LAAKALV | 8427 | CTTGCGGCTAAGGCTCTGGTT | 1915 | 8616 |
| LGTTSAS | 8428 | CTGGGGACGACTTCTGCGTCG | 1914 | 8617 |
| RGDHGTI | 8429 | CGTGGGGATCATGGGACGATT | 1914 | 8618 |
| GLRVVQA | 8430 | GGACTCCGAGTAGTCCAAGCC | 1913 | 8619 |
| RQTVGMG | 8431 | CGTCAGACTGTGGGGATGGGT | 1909 | 8620 |
| RGDLLTN | 8432 | AGGGGGGATCTGTTGACGAAT | 1905 | 8621 |
| YGHGMVG | 8433 | TACGGACACGGCATGGTCGGG | 1904 | 8622 |
| VVAALRG | 8434 | GTTGTTGCTGCTCTTCGGGGT | 1904 | 8623 |
| QLSRSGT | 8435 | CAGTTGTCGAGGAGTGGTACG | 1902 | 8624 |
| GLSRTGV | 8436 | GGTCTTTCGAGGACGGGGTG | 1902 | 8625 |
| MGGGRLT | 8437 | ATGGGTGGTGGTCGTCTTACT | 1896 | 8626 |
| RGDLVMV | 8438 | AGAGGCGACTTAGTGATGGTG | 1896 | 8627 |
| RGDVVGL | 8439 | AGGGGTGACGTCGTAGGCCTG | 1888 | 8628 |
| VTKVGVL | 8440 | GTGACGAAGGTTGGGGTGCTG | 1887 | 8629 |
| RTSYPEA | 8441 | CGCACCTCATACCCTGAAGCC | 1887 | 8630 |
| ESRATMS | 8442 | GAATCGCGGGCAACGATGTCT | 1885 | 8631 |
| SRVGVGA | 8443 | AGTCGGGTGGGTGTTGGTGCG | 1883 | 8632 |
| RGDYVTM | 8444 | CGAGGCGACTACGTGACTATG | 1880 | 8633 |
| RAQGPQA | 8445 | AGGGCTCAGGGTCCTCAGGCG | 1878 | 8634 |
| VTSHAMA | 8446 | GTCACATCCCACGCCATGGCC | 1877 | 8635 |
| RGDLGGV | 8447 | CGAGGGGACTTAGGCGGCGTC | 1873 | 8636 |
| SIRGELG | 8448 | AGTATTCGTGGTGAGCTGGGT | 1867 | 8637 |
| RGDGSAL | 8449 | CGTGGTGATGGGAGTGCTCTT | 1863 | 8638 |
| SRSGIAI | 8450 | TCTAGGAGTGGTATTGCGATT | 1860 | 8639 |
| QAGTLGY | 8451 | CAGGCGGGACGCTTGGGTAT | 1860 | 8640 |
| RGDLTTA | 8452 | AGGGGTGATCTTACGACTGCG | 1859 | 8641 |
| LGHRGDV | 8453 | CTTGGTCATCGGGGTGATGTT | 1859 | 8642 |
| RGDLTIT | 8454 | AGAGGCGACCTGACCATCACA | 1856 | 8643 |
| RGDLRVP | 8455 | CGTGGGGATCTTCGGGTGCCT | 1856 | 8644 |

TABLE 8-continued

| N-Mer Motif | SEQ ID NO: | Encoding Sequence | score | SEQ ID NO: |
|---|---|---|---|---|
| NSDHRIL | 8456 | AACTCGGACCACCGCATACTC | 1852 | 8645 |
| RGDYHSF | 8457 | CGTGGAGACTACCACTCATTC | 1851 | 8646 |
| GTGRYVS | 8458 | GGGACAGGTCGATACGTGAGC | 1851 | 8647 |
| PLLRSGT | 8459 | CCGTTGTTGAGGAGTGGGACG | 1849 | 8648 |
| RGDVVSW | 8460 | CGTGGAGACGTCGTAAGTTGG | 1849 | 8649 |
| VMRVGHA | 8461 | GTGATGCGTGTGGGGCATGCT | 1848 | 8650 |
| RGDLVSV | 8462 | AGGGGGGATCTGGTGTCTGTT | 1847 | 8651 |
| RGDLTGV | 8463 | CGGGGTGATTTGACGGGGGTG | 1845 | 8652 |
| VSSTKMA | 8464 | GTGTCGTCTACGAAGATGGCT | 1844 | 8653 |
| RGDHTQW | 8465 | CGCGGAGACCACACGCAATGG | 1843 | 8654 |
| VVRGVTD | 8466 | GTAGTTAGAGGTGTGACCGAC | 1842 | 8655 |
| VQVAVQR | 8467 | GTTCAGGTTGCGGTGCAGAGG | 1838 | 8656 |
| RTVTAVE | 8468 | CGTACTGTGACGGCGGTGGAG | 1838 | 8657 |
| RTQLGMA | 8469 | CGAACTCAATTAGGAATGGCG | 1835 | 8658 |
| GGSVRGS | 8470 | GGGGGGTTCGGTGAGGGGTTCG | 1835 | 8659 |
| RGDHSSL | 8471 | AGGGGGGATCATTCTAGTCTG | 1834 | 8660 |
| LAGTSGA | 8472 | CTTGCTGGGACTAGTGGGGCG | 1831 | 8661 |
| LRTGTLS | 8473 | CTTAGGACTGGGACTTTGAGT | 1830 | 8662 |
| WKAQVQA | 8474 | TGGAAAGCCCAAGTTCAAGCT | 1827 | 8663 |
| NSTALRG | 8475 | AATTCTACGGCTCTTCGTGGG | 1825 | 8664 |
| DGGRMAY | 8476 | GACGGTGGGCGAATGGCTTAC | 1825 | 8665 |
| TRTPSPA | 8477 | ACAAGAACACCTTCTCCCGCT | 1824 | 8666 |
| STVARGD | 8478 | TCAACGGTCGCAAGGGGGAC | 1823 | 8667 |
| RAGTAMS | 8479 | AGGGCTGGCACGGCCATGAGT | 1822 | 8668 |
| RGDRESH | 8480 | AGGGGGGATCGTGAGAGTCAT | 1820 | 8669 |
| LSRSGEL | 8481 | CTGAGTCGGAGTGGTGAGCTG | 1819 | 8670 |
| TAGRVQV | 8482 | ACTGCTGGGCGTGTTCAGGTG | 1813 | 8671 |
| VTTRGDV | 8483 | GTGACGACTCGTGGTGATGTG | 1809 | 8672 |
| VMRAGTS | 8484 | GTTATGCGTGCGGGGACTAGT | 1809 | 8673 |
| LSRSGDL | 8485 | TTGTCTCGGAGTGGTGATCTT | 1808 | 8674 |
| GYGHDRS | 8486 | GGTTATGGTCATGATCGGAGT | 1807 | 8675 |
| HAYKTSP | 8487 | CATGCTTATAAGACGTCTCCT | 1804 | 8676 |
| SPGKSGG | 8488 | AGTCCGGGTAAGTCTGGGGGT | 1802 | 8677 |
| SAGKTVV | 8489 | TCGGCGGGGAAGACGGTTGTT | 1799 | 8678 |
| VRGQQND | 8490 | GTGAGGGGGCAGCAGAATGAT | 1799 | 8679 |
| AVTRGGF | 8491 | GCTGTGACTAGGGGTGGTTTT | 1796 | 8680 |
| RGDLYTP | 8492 | AGGGGTGATCTTTATACGCCG | 1796 | 8681 |
| RAGTAIT | 8493 | CGTGCGGGTACTGCTATTACT | 1796 | 8682 |
| SLVRAAA | 8494 | TCGTTGGTTCGTGCTGCTGCT | 1795 | 8683 |
| VVRGDVG | 8495 | GTCGTCCGAGGCGACGTCGGC | 1793 | 8684 |
| RGDLSGT | 8496 | CGTGGTGATCTTTCGGGTACG | 1792 | 8685 |
| RYGATGT | 8497 | AGGTATGGTGCTACGGGGACT | 1787 | 8686 |
| PGLRGVA | 8498 | CCTGGTCTGAGGGGGGTTGCG | 1782 | 8687 |
| IPMRGQM | 8499 | ATTCCGATGAGGGGTCAGATG | 1781 | 8688 |
| SAGRSQG | 8500 | AGTGCTGGTCGTAGTCAGGGG | 1779 | 8689 |
| VRGVGTA | 8501 | GTTCGGGGGGTTGGTACGGCT | 1778 | 8690 |
| RGDYVSV | 8502 | CGGGGAGACTACGTCAGTGTC | 1777 | 8691 |

TABLE 9

| Rank | N-mer motif | SEQ ID NO: | Encoding sequence | SEQ ID NO: |
|---|---|---|---|---|
| 1 | RGDYVGL | 8692 | CGGGGTGATTATGTGGGGCTG | 8890 |
| 2 | RGDYSSV | 8693 | CGGGGTGATTATTCGAGTGTT | 8891 |
| 3 | RGDYSGL | 8694 | CGGGGTGATTATTCGGGGTTG | 8892 |
| 4 | RGDHERL | 8695 | CGTGGTGATCATGAGCGTTTG | 8893 |
| 5 | RGDLTVT | 8696 | AGGGGGGACCTGACAGTCACG | 8894 |
| 6 | RGDYHAI | 8697 | AGGGGCGACTACCACGCCATC | 8895 |
| 7 | RGDYREL | 8698 | AGAGGAGACTACCGGGAACTC | 8896 |
| 8 | RGDHGVL | 8699 | CGGGGTGATCATGGGGTTCTT | 8897 |
| 9 | RGDHASW | 8700 | CGTGGTGATCATGCTTCTTGG | 8898 |
| 10 | RGDYSGL | 8701 | CGTGGCGACTACTCTGGTCTA | 8899 |
| 11 | RGDAMHL | 8702 | CGTGGGGATGCGATGCATCTG | 8900 |
| 12 | RGDHVSL | 8703 | CGTGGGGATCATGTGTCTTTG | 8901 |
| 13 | RGDHGQL | 8704 | CGGGGGGATCATGGGCAGTTG | 8902 |
| 14 | RGDYGGL | 8705 | CGTGGTGATTATGGTGGGCTG | 8903 |
| 15 | RGDYVTM | 8706 | CGAGGCGACTACGTGACTATG | 8904 |
| 16 | RGDHSTW | 8707 | CGCGGGGACCACTCTACCTGG | 8905 |
| 17 | RGDLSGT | 8708 | AGGGGCGACCTGTCTGGCACC | 8906 |
| 18 | RGDYREM | 8709 | CGGGGGGATTATCGTGAGATG | 8907 |
| 19 | RGDTERL | 8710 | AGAGGGGACACCGAAAGATTG | 8908 |
| 20 | RGDHSTW | 8711 | CGGGGTGATCATAGTACTTGG | 8909 |
| 21 | RGDLSGT | 8712 | CGTGGTGATCTTTCGGGTACG | 8910 |
| 22 | RGDHASW | 8713 | CGGGGGGATCATGCTTCTTGG | 8911 |
| 23 | RGDLSSV | 8714 | CGGGGTGATCTTTCGAGTGTT | 8912 |
| 24 | RGDTVVL | 8715 | CGAGGAGACACGGTGGTCCTA | 8913 |
| 25 | RGDAAGL | 8716 | CGTGGGGACGCGGCTGGGTTG | 8914 |

TABLE 9-continued

| Rank | N-mer motif | SEQ ID NO: | Encoding sequence | SEQ ID NO: |
|---|---|---|---|---|
| 26 | RGDGATL | 8717 | CGGGGTGATGGTGCGACTCTG | 8915 |
| 27 | RGDYASL | 8718 | AGGGGTGATTATGCGTCTCTT | 8916 |
| 28 | MTARNPM | 8719 | ATGACTGCTCGGAATCCGATG | 8917 |
| 29 | YVVGSRS | 8720 | TATGTGGTGGGGAGTAGGAGT | 8918 |
| 30 | YAVGSRS | 8721 | TATGCGGTGGGGAGTAGGAGT | 8919 |
| 31 | RGDYVGL | 8722 | CGCGGGGACTACGTAGGTTTA | 8920 |
| 32 | RGDLTTT | 8723 | CGGGGTGACCTGACAACCACG | 8921 |
| 33 | RGDYERL | 8724 | CGCGGTGACTACGAACGACTA | 8922 |
| 34 | RGDYREL | 8725 | CGTGGTGATTATCGTGAGTTG | 8923 |
| 35 | RGDHGVL | 8726 | CGCGGAGACCACGGTGTATTA | 8924 |
| 36 | RGDYHAI | 8727 | CGTGGTGATTATCATGCTATT | 8925 |
| 37 | RGDHTQW | 8728 | CGCGGAGACCACACGCAATGG | 8926 |
| 38 | RGDLLGT | 8729 | CGGGGTGATTTGTTGGGGACT | 8927 |
| 39 | RGDLTGV | 8730 | CGGGGTGATTTGACGGGGGTG | 8928 |
| 40 | RGDSYTL | 8731 | CGTGGCGACTCCTACACCTTG | 8929 |
| 41 | RGDYGTV | 8732 | CGCGGAGACTACGGAACGGTC | 8930 |
| 42 | RGDVVGL | 8733 | AGGGGTGACGTCGTAGGCCTG | 8931 |
| 43 | RGDTERL | 8734 | CGGGGTGATACTGAGCGTCTG | 8932 |
| 44 | RGDHSSL | 8735 | CGCGGCGACCACTCCTCATTG | 8933 |
| 45 | RGDHGQL | 8736 | AGGGGCGACCACGGTCAACTT | 8934 |
| 46 | RGDVTGM | 8737 | CGTGGCGACGTAACTGGAATG | 8935 |
| 47 | RGDYGGL | 8738 | CGCGGCGACTACGGGGCTTA | 8936 |
| 48 | RGDYAGH | 8739 | CGTGGGGATTATGCGGGGCAT | 8937 |
| 49 | RGDIVGL | 8740 | AGGGGTGACATAGTGGGCCTC | 8938 |
| 50 | RGDLVGY | 8741 | AGGGGGGATCTTGTGGGGTAT | 8939 |
| 51 | RGDGAHL | 8742 | CGTGGTGATGGTGCTCATCTG | 8940 |
| 52 | RGDQVVV | 8743 | CGTGGTGATCAGGTTGTGGTT | 8941 |
| 53 | RGDTMGM | 8744 | CGTGGGGATACGATGGGTATG | 8942 |
| 54 | RGDLLGT | 8745 | CGTGGGGATTTGTTGGGGACT | 8943 |
| 55 | RGDLSGN | 8746 | CGTGGGGATCTTTCTGGTAAT | 8944 |
| 56 | FNVSTRT | 8747 | TTCAACGTAAGTACGAGAACA | 8945 |
| 57 | RGDRTVI | 8748 | CGTGGTGATCGTACTGTGATT | 8946 |
| 58 | RGDVSGI | 8749 | CGTGGTGATGTTAGTGGGATT | 8947 |
| 59 | RGDYASL | 8750 | CGGGGCGACTACGCAAGCCTG | 8948 |
| 60 | RGDQALI | 8751 | CGTGGTGATCAGGCGCTTATT | 8949 |
| 61 | RGDRDSW | 8752 | CGTGGTGATCGTGATTCGTGG | 8950 |
| 62 | RGDREGL | 8753 | CGTGGTGATCGTGAGGGTCTT | 8951 |
| 63 | RGDYVSV | 8754 | CGGGGAGACTACGTCAGTGTC | 8952 |
| 64 | RGDTMRL | 8755 | CGCGGAGACACGATGAGACTG | 8953 |
| 65 | RGDYAHT | 8756 | AGGGGTGACTACGCTCACACG | 8954 |
| 66 | RGDTEKL | 8757 | CGGGGTGATACGGAGAAGTTG | 8955 |
| 67 | RGDWQV | 8758 | AGGGGGGATCAGTGGCAGGTG | 8956 |
| 68 | RGDILNV | 8759 | CGGGGTGATATTCTGAATGTG | 8957 |
| 69 | RGDREQV | 8760 | CGTGGTGATCGTGAGCAGGTT | 8958 |
| 70 | RGDNWQM | 8761 | CGAGGCGACAACTGGCAAATG | 8959 |
| 71 | RGDYGGM | 8762 | AGGGGGGATTATGGTGGGATG | 8960 |
| 72 | RGDLDGR | 8763 | CGTGGTGATCTGGATGGGCGG | 8961 |
| 73 | RGDHERL | 8764 | AGAGGGGACCACGAACGGCTT | 8962 |
| 74 | RGDLGVV | 8765 | AGGGGTGATCTGGGTGTGGTG | 8963 |
| 75 | RGDRESH | 8766 | CGCGGAGACCGAGAAAGCCAC | 8964 |
| 76 | RGDAATM | 8767 | CGGGGGGATGCTGCGACGATG | 8965 |
| 77 | RGDLGGV | 8768 | CGTGGTGATTTGGGTGGGGTG | 8966 |
| 78 | RGDAGQL | 8769 | CGGGGTGATGCGGGGCAGCTT | 8967 |
| 79 | RGDRGEI | 8770 | CGGGGGGATCGTGGTGAGATT | 8968 |
| 80 | RGDVVSW | 8771 | CGTGGAGACGTCGTAAGTTGG | 8969 |
| 81 | MTARSPM | 8772 | ATGACTGCTCGGAGTCCGATG | 8970 |
| 82 | TIRDGRL | 8773 | ACGATCCGTGACGGCAGGTTG | 8971 |
| 83 | RGDIVGL | 8774 | CGTGGGGATATTGTMGTCTG | 8972 |
| 84 | RGDYQAV | 8775 | CGCGGTGACTACCAAGCAGTG | 8973 |
| 85 | RGDGAHM | 8776 | CGTGGTGATGGGGCGCATATG | 8974 |
| 86 | RGDAASI | 8777 | CGGGGTGATGCTGCTTCGATT | 8975 |
| 87 | RGDNSQW | 8778 | CGTGGGGATAATTCTCAGTGG | 8976 |
| 88 | RGDHSGL | 8779 | AGAGGCGACCACTCGGGCCTC | 8977 |
| 89 | RGDMGGT | 8780 | CGAGGCGACATGGGAGGCACC | 8978 |
| 90 | RGDLTGV | 8781 | AGGGGAGACCTCACAGGTGTA | 8979 |
| 91 | RGDVSGY | 8782 | CGGGGTGATGTGTCTGGTTAT | 8980 |
| 92 | RGDLTTT | 8783 | CGTGGGGATCTTACTACGACT | 8981 |
| 93 | RGDYGTV | 8784 | AGGGGTGATTATGGGACTGTT | 8982 |
| 94 | RGDTMGM | 8785 | CGCGGTGACACCATGGGCATG | 8983 |
| 95 | RGDYSSV | 8786 | CGTGGGGATTATTCGTCTGTG | 8984 |
| 96 | RGDYGGM | 8787 | CGGGGTGACTACGGCGGTATG | 8985 |
| 97 | RGDYVSV | 8788 | CGTGGGGATTATGTGTCTGTG | 8986 |
| 98 | RGDVTGL | 8789 | CGTGGAGACGTGACCGACTG | 8987 |
| 99 | RGDLLTN | 8790 | CGAGGTGACCTTCTCACAAAC | 8988 |
| 100 | RGDHSGW | 8791 | CGTGGTGATCATAGTGGTTGG | 8989 |
| 101 | VSRGDVP | 8792 | GTTAGTCGGGGTGATGTGCCT | 8990 |
| 102 | RGDVSGM | 8793 | CGTGGTGATGTGAGTGGGATG | 8991 |

TABLE 9-continued

| Rank | N-mer motif | SEQ ID NO: | Encoding sequence | SEQ ID NO: |
|---|---|---|---|---|
| 103 | RGDRVGM | 8794 | CGGGGAGACCGCGTGGGCATG | 8992 |
| 104 | RGDGGVL | 8795 | CGTGGGGATGGTGGTGTGCTT | 8993 |
| 105 | RGDYVTI | 8796 | AGGGGTGATTATGTGACGATT | 8994 |
| 106 | RGDIAGV | 8797 | CGGGGTGATATTGCTGGTGTT | 8995 |
| 107 | RGDREQV | 8798 | CGCGGAGACAGAGAACAAGTG | 8996 |
| 108 | RGDLDNK | 8799 | CGTGGGGATTTGGATAATAAG | 8997 |
| 109 | RGDLTSV | 8800 | CGTGGTGATCTGACGTCTGTT | 8998 |
| 110 | FNVSVRN | 8801 | TTCAACGTAAGTGTTCGCAAC | 8999 |
| 111 | RGDLVHT | 8802 | CGTGGTGATCTGGTTCATACT | 9000 |
| 112 | RGDHGVI | 8803 | AGGGGTGACCACGGTGTGATA | 9001 |
| 113 | RGDAREM | 8804 | CGTGGTGATGCTCGTGAGATG | 9002 |
| 114 | RGDQASY | 8805 | CGTGGTGATCAGGCGTCTTAT | 9003 |
| 115 | RGDHSSL | 8806 | AGGGGGGATCATTCTAGTCTG | 9004 |
| 116 | RGDVRVI | 8807 | CGAGGCGACGTTCGGGTCATA | 9005 |
| 117 | TVGRGDT | 8808 | ACGGTTGGTCGTGGTGATACG | 9006 |
| 118 | RGDHGSL | 8809 | CGAGGCGACCACGGTTCACTG | 9007 |
| 119 | RGDFERT | 8810 | CGAGGGGACTTCGAACGAACC | 9008 |
| 120 | RGDHSGL | 8811 | CGTGGTGATCATAGTGGGCTT | 9009 |
| 121 | RGDMSTV | 8812 | AGAGGCGACATGTCTACGGTG | 9010 |
| 122 | RGDYATL | 8813 | CGGGGTGATTATGCTACGCTT | 9011 |
| 123 | LPGVGHA | 8814 | CTGCCTGGTGTGGGTCATGCT | 9012 |
| 124 | RGDALHL | 8815 | AGGGGCGACGCGCTCCACCTT | 9013 |
| 125 | SGGTYLA | 8816 | AGCGGGGGAACGTACCTTGCC | 9014 |
| 126 | RGDVVHL | 8817 | AGGGGTGATGTTGTGCATCTG | 9015 |
| 127 | RGDQVQL | 8818 | CGGGGTGATCAGGTGCAGCTG | 9016 |
| 128 | SSIGVKI | 8819 | TCGTCGATTGGTGTGAAGATT | 9017 |
| 129 | RGDHMSL | 8820 | CGCGGCGACCACATGTCTCTA | 9018 |
| 130 | RGDMSTV | 8821 | AGGGGGGATATGAGTACTGTT | 9019 |
| 131 | VMRAGAT | 8822 | GTTATGCGAGCAGGTGCGACG | 9020 |
| 132 | RGDVVGL | 8823 | CGGGGGGATGTTGTTGGGCTT | 9021 |
| 133 | RGDTVVL | 8824 | CGTGGTGATACTGTTGTGTTG | 9022 |
| 134 | GTKVGVL | 8825 | GGGACGAAGGTTGGTGTGCTG | 9023 |
| 135 | TGVHTRV | 8826 | ACAGGAGTGCACACCCGGGTT | 9024 |
| 136 | RGDAGVL | 8827 | CGTGGTGATGCTGGGGTTCTT | 9025 |
| 137 | RGDLSTT | 8828 | CGTGGTGATCTTTCGACTACT | 9026 |
| 138 | RGDRLQI | 8829 | CGTGGTGATCGGCTTCAGATT | 9027 |
| 139 | RGDAVTL | 8830 | CGTGGGGATGCGGTGACTTTG | 9028 |
| 140 | RGDMVSV | 8831 | CGGGGGGATATGGTTAGTGTG | 9029 |
| 141 | RGDRENL | 8832 | CGTGGGGATAGGGAGAATCTT | 9030 |
| 142 | RGDGAAM | 8833 | CGTGGGGATGGTGCGGCGATG | 9031 |
| 143 | RGDLTRT | 8834 | CGGGGGGATCTTACTAGGACG | 9032 |
| 144 | RGDYGGI | 8835 | CGTGGGGATTATGGTGGTATT | 9033 |
| 145 | RGDMEPR | 8836 | CGGGGTGATATGGAGCCTCGT | 9034 |
| 146 | RGDTAVQ | 8837 | CGTGGGGATACGGCGGTTCAG | 9035 |
| 147 | AVTRGGV | 8838 | GCTGTGACTAGGGGTGGTGTT | 9036 |
| 148 | VSAARSL | 8839 | GTGAGTGCGGCGCGTTCTCTG | 9037 |
| 149 | GRLPQQT | 8840 | GGTCGGCTTCCTCAGCAGACT | 9038 |
| 150 | RGDLVGY | 8841 | CGAGGCGACTTGGTTGGTTAC | 9039 |
| 151 | RGDLVTV | 8842 | CGGGGGGATCTGGTTACGGTT | 9040 |
| 152 | RGDYVVH | 8843 | CGCGGGGACTACGTCGTTCAC | 9041 |
| 153 | RGDAARL | 8844 | CGCGGCGACGCTGCACGACTA | 9042 |
| 154 | RGDYTGV | 8845 | AGGGGTGACTACACAGGCGTC | 9043 |
| 155 | RGDLGGT | 8846 | AGGGGTGATCTTGGGGGTACG | 9044 |
| 156 | RGDTVYL | 8847 | CGGGGTGATACGGTGTATCTG | 9045 |
| 157 | RGDLMGS | 8848 | CGGGGGGATCTTATGGGGAGT | 9046 |
| 158 | LGRGDVS | 8849 | TTGGGTCGGGGTGATGTGTCG | 9047 |
| 159 | TAGRVQV | 8850 | ACTGCTGGGCGTGTTCAGGTG | 9048 |
| 160 | VVVRGGV | 8851 | GTGGTGGTGCGTGGTGGGGTT | 9049 |
| 161 | RGDHTNI | 8852 | AGAGGGGACCACACTAACATC | 9050 |
| 162 | RGDLVGI | 8853 | AGGGGCGACTTAGTAGGAATC | 9051 |
| 163 | RGDLSPV | 8854 | AGAGGAGACTTGTCCCCGGTG | 9052 |
| 164 | RGDLSGV | 8855 | CGGGGTGATTTGTCGGGGGTT | 9053 |
| 165 | YGIAARS | 8856 | TACGGCATCGCAGCAAGATCT | 9054 |
| 166 | RGDREGL | 8857 | CGGGGGGACCGAGAAGGGCTA | 9055 |
| 167 | RGDLHST | 8858 | CGTGGTGATTTGCATTCGACG | 9056 |
| 168 | RGDATGW | 8859 | CGGGGTGATGCGACGGGTTGG | 9057 |
| 169 | RGDQSHV | 8860 | CGAGGCGACCAAAGCCACGTA | 9058 |
| 170 | DKRVGTP | 8861 | GATAAGAGGGTTGGGACTCCT | 9059 |
| 171 | RGDLVVT | 8862 | AGAGGCGACCTGGTCGTAACT | 9060 |
| 172 | RGDFGGV | 8863 | AGGGGTGACTTCGGAGGTGTC | 9061 |
| 173 | RGDLSNT | 8864 | CGTGGAGACCTCAGCAACACA | 9062 |
| 174 | HRGQAVD | 8865 | CATCGGGGTCAGGCGGTGGAT | 9063 |
| 175 | SMVRSGT | 8866 | AGTATGGTTCGTTCGGGGACG | 9064 |
| 176 | TSVSVKY | 8867 | ACTTCTGTGTCGGTGAAGTAT | 9065 |
| 177 | RGDYSQI | 8868 | AGAGGCGACTACAGCCAAATA | 9066 |
| 178 | RGDISGV | 8869 | CGGGGTGATATTTCGGGGGTT | 9067 |
| 179 | RGDVAGV | 8870 | CGGGGTGATGTGGCGGGGGTT | 9068 |

TABLE 9-continued

| N-mer Rank motif | SEQ ID NO: | Encoding sequence | SEQ ID NO: |
|---|---|---|---|
| 180 RGDQVTI | 8871 | AGGGGTGATCAGGTTACTATT | 9069 |
| 181 RGDRLVI | 8872 | AGAGGAGACAGGCTGGTCATC | 9070 |
| 182 PLLRSGT | 8873 | CCGTTGTTGAGGAGTGGGACG | 9071 |
| 183 RGDFGSV | 8874 | CGGGGTGATTTTGGTAGTGTG | 9072 |
| 184 RGDVAYV | 8875 | CGGGGTGATGTTGCTTATGTG | 9073 |
| 185 ARMGTGV | 8876 | GCTCGTATGGGTACGGGTGTG | 9074 |
| 186 VMRVGHA | 8877 | GTGATGCGTGTGGGGCATGCT | 9075 |
| 187 ARVQSSP | 8878 | GCTCGTGTTCAGAGTTCGCCT | 9076 |
| 188 RGDGGIL | 8879 | CGGGGTGATGGGGGATTCTT | 9077 |
| 189 RSDLGAL | 8880 | AGGTCTGATCTTGGGGCTTTG | 9078 |
| 190 SYSRSAV | 8881 | TCGTATTCGCGGAGTGCGGTT | 9079 |
| 191 RGDVLLV | 8882 | AGGGGGGATGTTCTTCTGGTG | 9080 |
| 192 TGVHTRV | 8883 | ACGGGTGTTCATACGAGGGTG | 9081 |
| 193 TVGNLRG | 8884 | ACTGTGGGGAATTTGCGTGGT | 9082 |
| 194 TVVGQGY | 8885 | ACTGTCGTCGGACAAGGTTAC | 9083 |
| 195 RGDGGAL | 8886 | CGTGGTGATGGTGGTGCTCTG | 9084 |
| 196 NSYHAGA | 8887 | AACAGCTACCACGCTGGGCC | 9085 |
| 197 RGDLTVT | 8888 | CGGGGTGATTTGACTGTGACT | 9086 |
| 198 RGDVHGF | 8889 | CGGGGAGACGTCCACGGCTTC | 9087 |

Muscle specific AAV capsids were developed using expression from two different muscle specific promoters and the resulting capsid libraries for each promoter were screened in non-human primates as described elsewhere herein and/or in U.S. Provisional Application Ser. Nos. 62/899,453, 62/916,207, 63/018,454, 63/055,252, and 62/916,221 and International Application No. PCT/US20/50534.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (9137 sequences)

SEQ ID NO: 1 - protein, 736 aa, synthetic construct
  REGION 1..736: note = AAV-9 reference seqeunce
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 2-12 - skipped (11 entries)

SEQ ID NO: 13 - protein, 7 aa, synthetic construct
  REGION 1..7: note = n-mer motif
RGDLSTP

SEQ ID NO: 14 - protein, 7 aa, synthetic construct
  REGION 1..7: note = n-mer motif
RGDLNQY

SEQ ID NO: 15 - protein, 7 aa, synthetic construct
  REGION 1..7: note = n-mer motif
RGDLTTP

SEQ ID NO: 16 - protein, 7 aa, synthetic construct
  REGION 1..7: note = n-mer motif
RGDATEL

SEQ ID NO: 17 - protein, 7 aa, synthetic construct
  REGION 1..7: note = n-mer motif
RGDQLYH

SEQ ID NO: 18 - protein, 7 aa, synthetic construct
  REGION 1..7: note = n-mer motif
RGDLSTP

SEQ ID NO: 19 - protein, 7 aa, synthetic construct
  REGION 1..7: note = n-mer motif
RGDVAAK

SEQ ID NO: 20 - protein, 7 aa, synthetic construct
  REGION 1..7: note = n-mer motif
RGDLTTP

SEQ ID NO: 21 - protein, 7 aa, synthetic construct
  REGION 1..7: note = n-mer motif
RGDLNQY

SEQ ID NO: 22 - protein, 7 aa, synthetic construct
  REGION 1..7: note = n-mer motif
RGDTMSK

SEQ ID NO: 23 - protein, 7 aa, synthetic construct
  REGION 1..7: note = n-mer motif
RGDVAAK

SEQ ID NO: 24 - protein, 7 aa, synthetic construct
  REGION 1..7: note = n-mer motif
RGDTMSK

SEQ ID NO: 25 - protein, 7 aa, synthetic construct
  REGION 1..7: note = n-mer motif
RGDATEL

SEQ ID NO: 26 - protein, 7 aa, synthetic construct
  REGION 1..7: note = n-mer motif
RGDLTTP

SEQ ID NO: 27 - protein, 7 aa, synthetic construct
  REGION 1..7: note = n-mer motif
RGDLNQY

SEQ ID NO: 28 - protein, 7 aa, synthetic construct
  REGION 1..7: note = n-mer motif
RGDLSTP

SEQ ID NO: 29 - protein, 7 aa, synthetic construct
  REGION 1..7: note = n-mer motif
RGDQLYH

SEQ ID NO: 30 - protein, 7 aa, synthetic construct
  REGION 1..7: note = n-mer motif
RGDTMSK

SEQ ID NO: 31 - protein, 7 aa, synthetic construct
  REGION 1..7: note = n-mer motif
RGDATEL

SEQ ID NO: 32 - protein, 7 aa, synthetic construct
  REGION 1..7: note = n-mer motif
RGDLSTP

SEQ ID NO: 33 - protein, 7 aa, synthetic construct
  REGION 1..7: note = n-mer motif
RGDMINT

SEQ ID NO: 34 - protein, 7 aa, synthetic construct
  REGION 1..7: note = n-mer motif
RGDLNQY

SEQ ID NO: 35 - protein, 7 aa, synthetic construct
  REGION 1..7: note = n-mer motif
RGDTMSK

SEQ ID NO: 36 - protein, 7 aa, synthetic construct
  REGION 1..7: note = n-mer motif
RGDLTTP

SEQ ID NO: 37 - protein, 7 aa, synthetic construct
  REGION 1..7: note = n-mer motif
RGDLNDS

SEQ ID NO: 38 - protein, 7 aa, synthetic construct
  REGION 1..7: note = n-mer motif
RGDLSTP

SEQ ID NO: 39 - protein, 7 aa, synthetic construct
  REGION 1..7: note = n-mer motif
RGDLSTP

SEQ ID NO: 40 - protein, 7 aa, synthetic construct
  REGION 1..7: note = n-mer motif
RGDLTTP

SEQ ID NO: 41 - protein, 7 aa, synthetic construct
  REGION 1..7: note = n-mer motif
RGDLNQY

SEQ ID NO: 42 - protein, 7 aa, synthetic construct
  REGION 1..7: note = n-mer motif
RGDQLYH

SEQ ID NO: 43 - protein, 7 aa, synthetic construct
  REGION 1..7: note = n-mer motif
RGDATEL

SEQ ID NO: 44 - protein, 7 aa, synthetic construct
  REGION 1..7: note = n-mer motif
RGDTMSK

SEQ ID NO: 45 - protein, 7 aa, synthetic construct
  REGION 1..7: note = n-mer motif
RGDLNQY

SEQ ID NO: 46 - protein, 7 aa, synthetic construct
  REGION 1..7: note = n-mer motif
RGDLTTP

SEQ ID NO: 47 - protein, 7 aa, synthetic construct
  REGION 1..7: note = n-mer motif
RGDMINT

SEQ ID NO: 48 - protein, 7 aa, synthetic construct
  REGION 1..7: note = n-mer motif
RGDTMSK

SEQ ID NO: 49 - protein, 7 aa, synthetic construct
  REGION 1..7: note = n-mer motif
RGDTMNY

SEQ ID NO: 50 - protein, 7 aa, synthetic construct
  REGION 1..7: note = n-mer motif
RGDATEL

SEQ ID NO: 51 - protein, 15 aa, synthetic construct
  REGION 1..15: note = Linker
GGGGGGGGGGGGGGG

SEQ ID NO: 52 - protein, 7 aa, synthetic construct
  REGION 1..7: note = Nuclear localization sequence
PKKKRKV

SEQ ID NO: 53 - protein, 10 aa, synthetic construct
  REGION 1..10: note = Nuclear localization sequence
PKKKRKVEAS

SEQ ID NO: 54 - protein, 16 aa, synthetic construct
  REGION 1..16: note = Nuclear localization sequence
KRPAATKKAGQAKKKK

SEQ ID NO: 55 - protein, 9 aa, synthetic construct
  REGION 1..9: note = Nuclear localization sequence
PAAKRVKLD

SEQ ID NO: 56 - protein, 15 aa, synthetic construct
  REGION 1..15: note = linker
GGGGSGGGGSGGGGS

SEQ ID NO: 57 - protein, 11 aa, synthetic construct
  REGION 1..11: note = Nuclear localization sequence
RQRRNELKRSP

SEQ ID NO: 58 - protein, 38 aa, synthetic construct
  REGION 1..38: note = Nuclear localization sequence
NQSSNFGPMKGGNFGGRSSGPYGGGGQYFAKPRNQGGY

SEQ ID NO: 59 - protein, 42 aa, synthetic construct
  REGION 1..42: note = Nuclear localization sequence
RMRIZFKNKGKDTAELRRRRVEVSVELRKAKKDEQILKRRNV

SEQ ID NO: 60 - DNA, 21 bp, synthetic construct
  misc_feature 1..21: note = n-mer motif encoding polynucleotide
  source 1..21: mol_type = other DNA
aggggtgatctttctacgcct

SEQ ID NO: 61 - DNA, 21 bp, synthetic construct
  misc_feature 1..21: note = n-mer motif encoding polynucleotide
  source 1..21: mol_type = other DNA
aggggcgacctgaaccaatac

SEQ ID NO: 62 - DNA, 21 bp, synthetic construct
  misc_feature 1..21: note = n-mer motif encoding polynucleotide
  source 1..21: mol_type = other DNA
cggggtgatcttactacgcct

SEQ ID NO: 63 - DNA, 21 bp, synthetic construct
  misc_feature 1..21: note = n-mer motif encoding polynucleotide
  source 1..21: mol_type = other DNA
aggggggatgcgacggagctt

SEQ ID NO: 64 - DNA, 21 bp, synthetic construct
  misc_feature 1..21: note = n-mer motif encoding polynucleotide
  source 1..21: mol_type = other DNA
cggggtgatcagctttatcat

SEQ ID NO: 65 - DNA, 21 bp, synthetic construct
  misc_feature 1..21: note = n-mer motif encoding polynucleotide
  source 1..21: mol_type = other DNA
agaggcgacttatccacaccc

SEQ ID NO: 66 - DNA, 21 bp, synthetic construct
  misc_feature 1..21: note = n-mer motif encoding polynucleotide
  source 1..21: mol_type = other DNA
cgtggtgatgtggcggctaag

SEQ ID NO: 67 - DNA, 21 bp, synthetic construct
  misc_feature 1..21: note = n-mer motif encoding polynucleotide
  source 1..21: mol_type = other DNA
agaggagacttgacaacccca

SEQ ID NO: 68 - DNA, 21 bp, synthetic construct
  misc_feature 1..21: note = n-mer motif encoding polynucleotide
  source 1..21: mol_type = other DNA
cggggtgatcttaatcagtat

SEQ ID NO: 69 - DNA, 21 bp, synthetic construct
  misc_feature 1..21: note = n-mer motif encoding polynucleotide
  source 1..21: mol_type = other DNA
cgaggagacaccatgagcaaa

SEQ ID NO: 70 - DNA, 21 bp, synthetic construct
  misc_feature 1..21: note = n-mer motif encoding polynucleotide
  source 1..21: mol_type = other DNA
cgcggagacgtagccgccaaa

SEQ ID NO: 71 - DNA, 21 bp, synthetic construct
  misc_feature 1..21: note = n-mer motif encoding polynucleotide
  source 1..21: mol_type = other DNA
cggggggatactatgtctaag

SEQ ID NO: 72 - DNA, 21 bp, synthetic construct
  misc_feature 1..21: note = n-mer motif encoding polynucleotide
  source 1..21: mol_type = other DNA
cggggtgacgcaacagaattg

SEQ ID NO: 73 - DNA, 21 bp, synthetic construct
  misc_feature 1..21: note = n-mer motif encoding polynucleotide
  source 1..21: mol_type = other DNA
gcacggtcaaacgactcggtc

SEQ ID NO: 74 - DNA, 21 bp, synthetic construct
  misc_feature 1..21: note = n-mer motif encoding polynucleotide
  source 1..21: mol_type = other DNA
cggggtgacatgaacaactca

SEQ ID NO: 75 - DNA, 21 bp, synthetic construct
  misc_feature 1..21: note = n-mer motif encoding polynucleotide
  source 1..21: mol_type = other DNA
acgatgggtgctaatggtact

SEQ ID NO: 76 - DNA, 21 bp, synthetic construct
  misc_feature 1..21: note = n-mer motif encoding polynucleotide
  source 1..21: mol_type = other DNA
cctaatgttacgcagtcttat

SEQ ID NO: 77 - DNA, 21 bp, synthetic construct
  misc_feature 1..21: note = n-mer motif encoding polynucleotide
  source 1..21: mol_type = other DNA
cgtttggacctgcaagtccac

SEQ ID NO: 78 - DNA, 21 bp, synthetic construct
  misc_feature 1..21: note = n-mer motif encoding polynucleotide
  source 1..21: mol_type = other DNA
gggctttctaaggcgtctgat

SEQ ID NO: 79 - DNA, 21 bp, synthetic construct
  misc_feature 1..21: note = n-mer motif encoding polynucleotide
  source 1..21: mol_type = other DNA
gatcctggtcggacgggtacg

SEQ ID NO: 80 - DNA, 21 bp, synthetic construct
  misc_feature 1..21: note = n-mer motif encoding polynucleotide
  source 1..21: mol_type = other DNA
tatcggggtagggaggattgg

SEQ ID NO: 81 - DNA, 21 bp, synthetic construct
  misc_feature 1..21: note = n-mer motif encoding polynucleotide
  source 1..21: mol_type = other DNA
agatacggagaatccatcgaa

SEQ ID NO: 82 - DNA, 21 bp, synthetic construct
  misc_feature 1..21: note = n-mer motif encoding polynucleotide
  source 1..21: mol_type = other DNA
agtctgaacaacatgggatcg

SEQ ID NO: 83 - DNA, 21 bp, synthetic construct
  misc_feature 1..21: note = n-mer motif encoding polynucleotide
  source 1..21: mol_type = other DNA
aatagtgatcagcggaattgg

SEQ ID NO: 84 - DNA, 21 bp, synthetic construct
  misc_feature 1..21: note = n-mer motif encoding polynucleotide
  source 1..21: mol_type = other DNA
cgtggtgatatgtctcgtgag

SEQ ID NO: 85 - DNA, 21 bp, synthetic construct
  misc_feature 1..21: note = n-mer motif encoding polynucleotide
  source 1..21: mol_type = other DNA
atgactgatgcgaataggatt

SEQ ID NO: 86 - DNA, 21 bp, synthetic construct
  misc_feature 1..21: note = n-mer motif encoding polynucleotide
  source 1..21: mol_type = other DNA
gtctacaacggcaacgtagta

SEQ ID NO: 87 - DNA, 21 bp, synthetic construct
  misc_feature 1..21: note = n-mer motif encoding polynucleotide
  source 1..21: mol_type = other DNA
cgtggggatatgattaatacg

SEQ ID NO: 88 - DNA, 21 bp, synthetic construct
  misc_feature 1..21: note = n-mer motif encoding polynucleotide
  source 1..21: mol_type = other DNA
agtggtctttcgcatggtcag

SEQ ID NO: 89 - DNA, 21 bp, synthetic construct
  misc_feature 1..21: note = n-mer motif encoding polynucleotide
  source 1..21: mol_type = other DNA
actggccaattagtaggaacc

SEQ ID NO: 90 - DNA, 21 bp, synthetic construct
  misc_feature 1..21: note = n-mer motif encoding polynucleotide
  source 1..21: mol_type = other DNA
gctaattctattgggggtccg

SEQ ID NO: 91 - DNA, 21 bp, synthetic construct
  misc_feature 1..21: note = n-mer motif encoding polynucleotide
  source 1..21: mol_type = other DNA
tacagtcaatcgctgtctgaa

SEQ ID NO: 92 - DNA, 21 bp, synthetic construct
  misc_feature 1..21: note = n-mer motif encoding polynucleotide
  source 1..21: mol_type = other DNA
tatcataagtatagtacggat

SEQ ID NO: 93 - DNA, 21 bp, synthetic construct
  misc_feature 1..21: note = n-mer motif encoding polynucleotide
  source 1..21: mol_type = other DNA
gctcgtcatgatgagcatgtg

SEQ ID NO: 94 - DNA, 21 bp, synthetic construct
  misc_feature 1..21: note = n-mer motif encoding polynucleotide
  source 1..21: mol_type = other DNA
gccatagactctatcaaacaa

SEQ ID NO: 95 - DNA, 21 bp, synthetic construct
  misc_feature 1..21: note = n-mer motif encoding polynucleotide
  source 1..21: mol_type = other DNA
cgtttggacctgcaagtcaac

SEQ ID NO: 96 - DNA, 21 bp, synthetic construct
  misc_feature 1..21: note = n-mer motif encoding polynucleotide
  source 1..21: mol_type = other DNA
cgcggcgacatgataaacacc

SEQ ID NO: 97 - DNA, 21 bp, synthetic construct
  misc_feature 1..21: note = n-mer motif encoding polynucleotide
  source 1..21: mol_type = other DNA
agtgtgttgtctcaggctaat

SEQ ID NO: 98 - DNA, 21 bp, synthetic construct
  misc_feature 1..21: note = n-mer motif encoding polynucleotide
  source 1..21: mol_type = other DNA
tttacggtgaatcaggatctt

SEQ ID NO: 99 - DNA, 21 bp, synthetic construct
  misc_feature 1..21: note = n-mer motif encoding polynucleotide
  source 1..21: mol_type = other DNA
acggataatggtcttcttgtg

SEQ ID NO: 100 - DNA, 21 bp, synthetic construct
  misc_feature 1..21: note = n-mer motif encoding polynucleotide
  source 1..21: mol_type = other DNA
tatcagcagacttctagtacg

SEQ ID NO: 101 - DNA, 21 bp, synthetic construct
  misc_feature 1..21: note = n-mer motif encoding polynucleotide
  source 1..21: mol_type = other DNA
acagaacaatcttactcacga

SEQ ID NO: 102 - DNA, 21 bp, synthetic construct
  misc_feature 1..21: note = n-mer motif encoding polynucleotide
  source 1..21: mol_type = other DNA
attatggggcttagtcaggct

SEQ ID NO: 103 - DNA, 21 bp, synthetic construct
  misc_feature 1..21: note = n-mer motif encoding polynucleotide
  source 1..21: mol_type = other DNA
gctactgcgcatcaggatggt

SEQ ID NO: 104 - DNA, 21 bp, synthetic construct
  misc_feature 1..21: note = n-mer motif encoding polynucleotide
  source 1..21: mol_type = other DNA
tataatgctactccttcgcag

SEQ ID NO: 105 - DNA, 21 bp, synthetic construct
  misc_feature 1..21: note = n-mer motif encoding polynucleotide
  source 1..21: mol_type = other DNA
tatacgcagggtattatgaat

SEQ ID NO: 106 - DNA, 21 bp, synthetic construct
  misc_feature 1..21: note = n-mer motif encoding polynucleotide
  source 1..21: mol_type = other DNA
gaatccctcccaatctctaaa

SEQ ID NO: 107 - DNA, 21 bp, synthetic construct
  misc_feature 1..21: note = n-mer motif encoding polynucleotide
  source 1..21: mol_type = other DNA
ggcaccgtcgttccgggctcc

SEQ ID NO: 108 - DNA, 21 bp, synthetic construct
  misc_feature 1..21: note = n-mer motif encoding polynucleotide
  source 1..21: mol_type = other DNA
ggattagctagtctacacctg

SEQ ID NO: 109 - DNA, 21 bp, synthetic construct
  misc_feature 1..21: note = n-mer motif encoding polynucleotide
  source 1..21: mol_type = other DNA
tatattgctgcgggtgagcag

SEQ ID NO: 110 - DNA, 21 bp, synthetic construct
  misc_feature 1..21: note = n-mer motif encoding polynucleotide
  source 1..21: mol_type = other DNA
aacacctaccccttcaacgcc

SEQ ID NO: 111 - DNA, 21 bp, synthetic construct
  misc_feature 1..21: note = n-mer motif encoding polynucleotide
  source 1..21: mol_type = other DNA
gttggtgcgagtacggcttcg

SEQ ID NO: 112 - DNA, 21 bp, synthetic construct
  misc_feature 1..21: note = n-mer motif encoding polynucleotide
  source 1..21: mol_type = other DNA
ggatccaactacttagcaaac

SEQ ID NO: 113 - DNA, 21 bp, synthetic construct
  misc_feature 1..21: note = n-mer motif encoding polynucleotide
  source 1..21: mol_type = other DNA
gatactggtcggacgggtacg

SEQ ID NO: 114 - DNA, 21 bp, synthetic construct
  misc_feature 1..21: note = n-mer motif encoding polynucleotide
  source 1..21: mol_type = other DNA
aagccgaatacgatgagtgat

SEQ ID NO: 115 - DNA, 21 bp, synthetic construct
  misc_feature 1..21: note = n-mer motif encoding polynucleotide
  source 1..21: mol_type = other DNA
gtagacaaatctagcccagtg

SEQ ID NO: 116 - DNA, 21 bp, synthetic construct
  misc_feature 1..21: note = n-mer motif encoding polynucleotide
  source 1..21: mol_type = other DNA
agttcggacccaaaaggtcaa

SEQ ID NO: 117 - DNA, 21 bp, synthetic construct
  misc_feature 1..21: note = n-mer motif encoding polynucleotide
  source 1..21: mol_type = other DNA
tggcagacgaatggtatgcag

SEQ ID NO: 118 - DNA, 21 bp, synthetic construct
  misc_feature 1..21: note = n-mer motif encoding polynucleotide
  source 1..21: mol_type = other DNA
accggtagcttgaactctatg

SEQ ID NO: 119 - DNA, 21 bp, synthetic construct
  misc_feature 1..21: note = n-mer motif encoding polynucleotide
  source 1..21: mol_type = other DNA
cattctaattcgagtcagaat

SEQ ID NO: 120 - DNA, 21 bp, synthetic construct
  misc_feature 1..21: note = n-mer motif encoding polynucleotide
  source 1..21: mol_type = other DNA
ggccgtgacgacctcacaaac

SEQ ID NO: 121 - DNA, 21 bp, synthetic construct
  misc_feature 1..21: note = n-mer motif encoding polynucleotide
  source 1..21: mol_type = other DNA
gatacttataagggtaagtgg

SEQ ID NO: 122 - DNA, 21 bp, synthetic construct
  misc_feature 1..21: note = n-mer motif encoding polynucleotide
  source 1..21: mol_type = other DNA
tatacggcgcagaccggctgg

SEQ ID NO: 123 - DNA, 21 bp, synthetic construct
  misc_feature 1..21: note = n-mer motif encoding polynucleotide
  source 1..21: mol_type = other DNA
aatcaggtgggtgcgtctgcg

SEQ ID NO: 124 - DNA, 21 bp, synthetic construct
  misc_feature 1..21: note = n-mer motif encoding polynucleotide
  source 1..21: mol_type = other DNA
atcgacgtactgaacggaagt

SEQ ID NO: 125 - DNA, 21 bp, synthetic construct
  misc_feature 1..21: note = n-mer motif encoding polynucleotide
  source 1..21: mol_type = other DNA
tttcggacggtgtatactggt

SEQ ID NO: 126 - DNA, 21 bp, synthetic construct
  misc_feature 1..21: note = n-mer motif encoding polynucleotide
  source 1..21: mol_type = other DNA
ggaaacatggtgactccaaac

SEQ ID NO: 127 - DNA, 21 bp, synthetic construct
  misc_feature 1..21: note = n-mer motif encoding polynucleotide
  source 1..21: mol_type = other DNA
gatacttataacggtaagtgg

SEQ ID NO: 128 - DNA, 21 bp, synthetic construct
  misc_feature 1..21: note = n-mer motif encoding polynucleotide
  source 1..21: mol_type = other DNA
accatccaagaccacataaaa

SEQ ID NO: 129 - DNA, 21 bp, synthetic construct
  misc_feature 1..21: note = n-mer motif encoding polynucleotide
  source 1..21: mol_type = other DNA
ggagcaaaaggaaccatgggc

SEQ ID NO: 130 - DNA, 21 bp, synthetic construct
  misc_feature 1..21: note = n-mer motif encoding polynucleotide
  source 1..21: mol_type = other DNA
acgaggagcaactccgacgaa

SEQ ID NO: 131 - DNA, 21 bp, synthetic construct
  misc_feature 1..21: note = n-mer motif encoding polynucleotide
  source 1..21: mol_type = other DNA
gctactactcttactggtgat

SEQ ID NO: 132 - DNA, 21 bp, synthetic construct
  misc_feature 1..21: note = n-mer motif encoding polynucleotide
  source 1..21: mol_type = other DNA
tcatacggaggatctggcccc

SEQ ID NO: 133 - DNA, 21 bp, synthetic construct
  misc_feature 1..21: note = n-mer motif encoding polynucleotide
  source 1..21: mol_type = other DNA
gaaaaatccgtcgaatccaaa

SEQ ID NO: 134 - DNA, 21 bp, synthetic construct
  misc_feature 1..21: note = n-mer motif encoding polynucleotide
  source 1..21: mol_type = other DNA
cgaggcgacacaatgaactac

SEQ ID NO: 135 - DNA, 21 bp, synthetic construct
  misc_feature 1..21: note = n-mer motif encoding polynucleotide
  source 1..21: mol_type = other DNA
cgggatctggggcagaccggc

SEQ ID NO: 136 - DNA, 21 bp, synthetic construct
  misc_feature 1..21: note = n-mer motif encoding polynucleotide
  source 1..21: mol_type = other DNA
agtccgcagctgagtgtgatg

SEQ ID NO: 137 - DNA, 21 bp, synthetic construct
  misc_feature 1..21: note = n-mer motif encoding polynucleotide
  source 1..21: mol_type = other DNA
cgaggagacaacagcacaccg

SEQ ID NO: 138 - DNA, 21 bp, synthetic construct
  misc_feature 1..21: note = n-mer motif encoding polynucleotide
  source 1..21: mol_type = other DNA
cctatggcaggacaccccccg

SEQ ID NO: 139 - DNA, 21 bp, synthetic construct
  misc_feature 1..21: note = n-mer motif encoding polynucleotide
  source 1..21: mol_type = other DNA
acggcgtatcaggctggtctg

SEQ ID NO: 140 - DNA, 21 bp, synthetic construct
  misc_feature 1..21: note = n-mer motif encoding polynucleotide
  source 1..21: mol_type = other DNA
gtggtaaaccaaggaaaccaa

SEQ ID NO: 141 - DNA, 21 bp, synthetic construct
  misc_feature 1..21: note = n-mer motif encoding polynucleotide
  source 1..21: mol_type = other DNA
gataagactgagatgctgcag

SEQ ID NO: 142 - DNA, 21 bp, synthetic construct
  misc_feature 1..21: note = n-mer motif encoding polynucleotide
  source 1..21: mol_type = other DNA
actgtgatgatgagtacgagg

SEQ ID NO: 143 - DNA, 21 bp, synthetic construct
  misc_feature 1..21: note = n-mer motif encoding polynucleotide
  source 1..21: mol_type = other DNA
cagcagaatacgcgtttgccg

SEQ ID NO: 144 - DNA, 21 bp, synthetic construct
  misc_feature 1..21: note = n-mer motif encoding polynucleotide
  source 1..21: mol_type = other DNA
taccaacacaaccaagcccac

SEQ ID NO: 145 - DNA, 21 bp, synthetic construct
  misc_feature 1..21: note = n-mer motif encoding polynucleotide
  source 1..21: mol_type = other DNA
aatcagagtattaataatatt

SEQ ID NO: 146 - DNA, 21 bp, synthetic construct
  misc_feature 1..21: note = n-mer motif encoding polynucleotide
  source 1..21: mol_type = other DNA
cgaggagaccacagcacaccg

SEQ ID NO: 147 - DNA, 21 bp, synthetic construct
  misc_feature 1..21: note = n-mer motif encoding polynucleotide
  source 1..21: mol_type = other DNA
gactctacacttcacttaagt

SEQ ID NO: 148 - DNA, 21 bp, synthetic construct
  misc_feature 1..21: note = n-mer motif encoding polynucleotide
  source 1..21: mol_type = other DNA
gcgaacatagaaaacacgtca

SEQ ID NO: 149 - DNA, 21 bp, synthetic construct
  misc_feature 1..21: note = n-mer motif encoding polynucleotide
  source 1..21: mol_type = other DNA
acaaacgctgctctagtacca

SEQ ID NO: 150 - DNA, 21 bp, synthetic construct
  misc_feature 1..21: note = n-mer motif encoding polynucleotide
  source 1..21: mol_type = other DNA
gggcagaaggagactactgcg

SEQ ID NO: 151 - DNA, 21 bp, synthetic construct
  misc_feature 1..21: note = n-mer motif encoding polynucleotide
  source 1..21: mol_type = other DNA
gaacttaacaccgcacacgca

SEQ ID NO: 152 - DNA, 21 bp, synthetic construct
  misc_feature 1..21: note = n-mer motif encoding polynucleotide
  source 1..21: mol_type = other DNA
ggtgttagtagtaattctgcg

SEQ ID NO: 153 - DNA, 21 bp, synthetic construct
  misc_feature 1..21: note = n-mer motif encoding polynucleotide
  source 1..21: mol_type = other DNA
agcacaaacgcgggacaaagg

SEQ ID NO: 154 - DNA, 21 bp, synthetic construct
  misc_feature 1..21: note = n-mer motif encoding polynucleotide
  source 1..21: mol_type = other DNA
gaacaacaaaaaacagacaac

SEQ ID NO: 155 - DNA, 21 bp, synthetic construct
  misc_feature 1..21: note = n-mer motif encoding polynucleotide
  source 1..21: mol_type = other DNA
gctgttgtgaatgagaatatg

SEQ ID NO: 156 - DNA, 21 bp, synthetic construct
  misc_feature 1..21: note = n-mer motif encoding polynucleotide
  source 1..21: mol_type = other DNA
ggcagcgtcagcaccagcgca

SEQ ID NO: 157 - DNA, 21 bp, synthetic construct
  misc_feature 1..21: note = n-mer motif encoding polynucleotide
  source 1..21: mol_type = other DNA
gagttgggtagtcagcgtatg

SEQ ID NO: 158 - DNA, 21 bp, synthetic construct
  misc_feature 1..21: note = n-mer motif encoding polynucleotide
  source 1..21: mol_type = other DNA
agaggcgacttatccacacac

SEQ ID NO: 159 - DNA, 21 bp, synthetic construct
  misc_feature 1..21: note = n-mer motif encoding polynucleotide
  source 1..21: mol_type = other DNA
gaccaccaacaagccctagct

SEQ ID NO: 160 - DNA, 21 bp, synthetic construct
  misc_feature 1..21: note = n-mer motif encoding polynucleotide
  source 1..21: mol_type = other DNA
aacagatctgacgctcacgaa

SEQ ID NO: 161 - DNA, 21 bp, synthetic construct
  misc_feature 1..21: note = n-mer motif encoding polynucleotide
  source 1..21: mol_type = other DNA
aatgttaatgcgcagagtagg

SEQ ID NO: 162 - DNA, 21 bp, synthetic construct
  misc_feature 1..21: note = n-mer motif encoding polynucleotide
  source 1..21: mol_type = other DNA
acccaagggaacaacatggta

SEQ ID NO: 163 - DNA, 21 bp, synthetic construct
  misc_feature 1..21: note = n-mer motif encoding polynucleotide
  source 1..21: mol_type = other DNA
acggcgctgaatacgtatcct

SEQ ID NO: 164 - DNA, 21 bp, synthetic construct
  misc_feature 1..21: note = n-mer motif encoding polynucleotide
  source 1..21: mol_type = other DNA
gtctctacatacctcctggca

SEQ ID NO: 165 - DNA, 21 bp, synthetic construct
  misc_feature 1..21: note = n-mer motif encoding polynucleotide
  source 1..21: mol_type = other DNA
ggcggcaactacaacacaact

SEQ ID NO: 166 - DNA, 21 bp, synthetic construct
  misc_feature 1..21: note = n-mer motif encoding polynucleotide
  source 1..21: mol_type = other DNA
agtaatattaagccggagatt

SEQ ID NO: 167 - DNA, 21 bp, synthetic construct
  misc_feature 1..21: note = n-mer motif encoding polynucleotide
  source 1..21: mol_type = other DNA
ccgagggtgcatggtcaggtt

SEQ ID NO: 168 - DNA, 21 bp, synthetic construct
  misc_feature 1..21: note = n-mer motif encoding polynucleotide
  source 1..21: mol_type = other DNA
tctaattctaatactgctgct

SEQ ID NO: 169 - DNA, 21 bp, synthetic construct
  misc_feature 1..21: note = n-mer motif encoding polynucleotide
  source 1..21: mol_type = other DNA
cttgaggtggcgacgagtccg

SEQ ID NO: 170 - DNA, 21 bp, synthetic construct
  misc_feature 1..21: note = n-mer motif encoding polynucleotide
  source 1..21: mol_type = other DNA
cacgacgccgacaaattagct

SEQ ID NO: 171 - DNA, 21 bp, synthetic construct
  misc_feature 1..21: note = n-mer motif encoding polynucleotide
  source 1..21: mol_type = other DNA
ggtgtgtatattgatggtcgg

SEQ ID NO: 172 - DNA, 21 bp, synthetic construct
  misc_feature 1..21: note = n-mer motif encoding polynucleotide
  source 1..21: mol_type = other DNA
tcgatgcagtcgtatacgatg

SEQ ID NO: 173 - DNA, 21 bp, synthetic construct
  misc_feature 1..21: note = n-mer motif encoding polynucleotide
  source 1..21: mol_type = other DNA
tctaaaggaaacgaacaaatg

SEQ ID NO: 174 - DNA, 21 bp, synthetic construct
  misc_feature 1..21: note = n-mer motif encoding polynucleotide
  source 1..21: mol_type = other DNA
ggtcgggattatgctatgagt

SEQ ID NO: 175 - DNA, 21 bp, synthetic construct
  misc_feature 1..21: note = n-mer motif encoding polynucleotide
  source 1..21: mol_type = other DNA
actgatggtatttttcagcct

SEQ ID NO: 176 - DNA, 21 bp, synthetic construct
  misc_feature 1..21: note = n-mer motif encoding polynucleotide
  source 1..21: mol_type = other DNA
gggagcccagtgatagtaaac

SEQ ID NO: 177 - DNA, 21 bp, synthetic construct
  misc_feature 1..21: note = n-mer motif encoding polynucleotide
  source 1..21: mol_type = other DNA
acattaacagacgttcaccga

SEQ ID NO: 178 - DNA, 21 bp, synthetic construct
  misc_feature 1..21: note = n-mer motif encoding polynucleotide
  source 1..21: mol_type = other DNA
aaaagcgaagtacccgcccga

SEQ ID NO: 179 - DNA, 21 bp, synthetic construct
  misc_feature 1..21: note = n-mer motif encoding polynucleotide
  source 1..21: mol_type = other DNA
gtcaacactggcgcactcttg

SEQ ID NO: 180 - DNA, 21 bp, synthetic construct
  misc_feature 1..21: note = n-mer motif encoding polynucleotide
  source 1..21: mol_type = other DNA
agtcagcagggttttactctg

SEQ ID NO: 181 - DNA, 21 bp, synthetic construct
  misc_feature 1..21: note = n-mer motif encoding polynucleotide
  source 1..21: mol_type = other DNA
aataataagtctgtgccggat

SEQ ID NO: 182 - DNA, 21 bp, synthetic construct
  misc_feature 1..21: note = n-mer motif encoding polynucleotide
  source 1..21: mol_type = other DNA
agtgtgatggtgggtacgaat

SEQ ID NO: 183 - DNA, 21 bp, synthetic construct
  misc_feature 1..21: note = n-mer motif encoding polynucleotide
  source 1..21: mol_type = other DNA
cgaaacgaaaacacttacaac

SEQ ID NO: 184 - DNA, 21 bp, synthetic construct
  misc_feature 1..21: note = n-mer motif encoding polynucleotide
  source 1..21: mol_type = other DNA
caagctaacttatcaataatc

SEQ ID NO: 185 - DNA, 21 bp, synthetic construct
  misc_feature 1..21: note = n-mer motif encoding polynucleotide
  source 1..21: mol_type = other DNA
cccggacgggacagcagaacg

SEQ ID NO: 186 - DNA, 21 bp, synthetic construct
  misc_feature 1..21: note = n-mer motif encoding polynucleotide
  source 1..21: mol_type = other DNA
tttccggctaatggtggtgct

SEQ ID NO: 187 - DNA, 21 bp, synthetic construct
  misc_feature 1..21: note = n-mer motif encoding polynucleotide
  source 1..21: mol_type = other DNA
gctggtaaggatcttagtaat

SEQ ID NO: 188 - DNA, 21 bp, synthetic construct
  misc_feature 1..21: note = n-mer motif encoding polynucleotide
  source 1..21: mol_type = other DNA
gcacaattcgaatcaggccga

SEQ ID NO: 189 - DNA, 21 bp, synthetic construct
  misc_feature 1..21: note = n-mer motif encoding polynucleotide
  source 1..21: mol_type = other DNA
ggatacggcagttacagcaac

SEQ ID NO: 190 - DNA, 21 bp, synthetic construct
  misc_feature 1..21: note = n-mer motif encoding polynucleotide
  source 1..21: mol_type = other DNA
acaatcgtttccgcttacgcc

SEQ ID NO: 191 - DNA, 21 bp, synthetic construct
  misc_feature 1..21: note = n-mer motif encoding polynucleotide
  source 1..21: mol_type = other DNA
aatgtgagtcctaatttgact

SEQ ID NO: 192 - DNA, 21 bp, synthetic construct
  misc_feature 1..21: note = n-mer motif encoding polynucleotide
  source 1..21: mol_type = other DNA
agaggcgacttatcaacaccc

SEQ ID NO: 193 - DNA, 21 bp, synthetic construct
  misc_feature 1..21: note = n-mer motif encoding polynucleotide
  source 1..21: mol_type = other DNA
ttcttagaaggagtcgctcaa

SEQ ID NO: 194 - DNA, 21 bp, synthetic construct
  misc_feature 1..21: note = n-mer motif encoding polynucleotide
  source 1..21: mol_type = other DNA
ggctccgaacgaggagaacga

SEQ ID NO: 195 - DNA, 21 bp, synthetic construct
  misc_feature 1..21: note = n-mer motif encoding polynucleotide
  source 1..21: mol_type = other DNA
ttgaatgttggttcgagtctt

SEQ ID NO: 196 - DNA, 21 bp, synthetic construct
  misc_feature 1..21: note = n-mer motif encoding polynucleotide
  source 1..21: mol_type = other DNA
cgtattgtggctaatgagcag

SEQ ID NO: 197 - DNA, 21 bp, synthetic construct
  misc_feature 1..21: note = n-mer motif encoding polynucleotide
  source 1..21: mol_type = other DNA
caatctatcggccaccccgtt

SEQ ID NO: 198 - DNA, 21 bp, synthetic construct
  misc_feature 1..21: note = n-mer motif encoding polynucleotide
  source 1..21: mol_type = other DNA
ggtggtatgtcggcgcattcg

SEQ ID NO: 199 - DNA, 21 bp, synthetic construct
  misc_feature 1..21: note = n-mer motif encoding polynucleotide
  source 1..21: mol_type = other DNA
cattctacgacgtctatgacg

SEQ ID NO: 200 - DNA, 21 bp, synthetic construct
  misc_feature 1..21: note = n-mer motif encoding polynucleotide
  source 1..21: mol_type = other DNA
actgtaaacggtacgaacgta

SEQ ID NO: 201 - DNA, 21 bp, synthetic construct
  misc_feature 1..21: note = n-mer motif encoding polynucleotide
  source 1..21: mol_type = other DNA
cttgcgcctgataatattggg

SEQ ID NO: 202 - DNA, 21 bp, synthetic construct
  misc_feature 1..21: note = n-mer motif encoding polynucleotide
  source 1..21: mol_type = other DNA
caaacagcgactctcgtggca

SEQ ID NO: 203 - DNA, 21 bp, synthetic construct
  misc_feature 1..21: note = n-mer motif encoding polynucleotide
  source 1..21: mol_type = other DNA
gcatcagcaccgtctgaattc

SEQ ID NO: 204 - DNA, 21 bp, synthetic construct
  misc_feature 1..21: note = n-mer motif encoding polynucleotide
  source 1..21: mol_type = other DNA
tcgatggagggtcagcagcat

SEQ ID NO: 205 - DNA, 21 bp, synthetic construct
  misc_feature 1..21: note = n-mer motif encoding polynucleotide
  source 1..21: mol_type = other DNA
caagacgtaggacgcacgaac

SEQ ID NO: 206 - DNA, 21 bp, synthetic construct
  misc_feature 1..21: note = n-mer motif encoding polynucleotide
  source 1..21: mol_type = other DNA
gtctacaacggcaacgaagta

SEQ ID NO: 207 - DNA, 21 bp, synthetic construct
  misc_feature 1..21: note = n-mer motif encoding polynucleotide
  source 1..21: mol_type = other DNA
gcacaggcgcagacaggctgg

SEQ ID NO: 208 - DNA, 21 bp, synthetic construct
  misc_feature 1..21: note = n-mer motif encoding polynucleotide
  source 1..21: mol_type = other DNA
cggctggatctgacgcatacg

SEQ ID NO: 209 - DNA, 21 bp, synthetic construct
  misc_feature 1..21: note = n-mer motif encoding polynucleotide
  source 1..21: mol_type = other DNA
gctgcacacggccgcgaacaa

SEQ ID NO: 210 - DNA, 21 bp, synthetic construct
  misc_feature 1..21: note = n-mer motif encoding polynucleotide
  source 1..21: mol_type = other DNA
agaggcgacttatacacaccc

SEQ ID NO: 211 - DNA, 21 bp, synthetic construct
  misc_feature 1..21: note = n-mer motif encoding polynucleotide
  source 1..21: mol_type = other DNA
ggtatgcagcagagggagaag

SEQ ID NO: 212 - DNA, 21 bp, synthetic construct
  misc_feature 1..21: note = n-mer motif encoding polynucleotide
  source 1..21: mol_type = other DNA
cagactcaggcgagtactaat

SEQ ID NO: 213 - DNA, 21 bp, synthetic construct
  misc_feature 1..21: note = n-mer motif encoding polynucleotide
  source 1..21: mol_type = other DNA
cgggacaccaacgccctcgga

SEQ ID NO: 214 - DNA, 21 bp, synthetic construct
  misc_feature 1..21: note = n-mer motif encoding polynucleotide
  source 1..21: mol_type = other DNA
tcgagtcagatttctaatagt

SEQ ID NO: 215 - DNA, 21 bp, synthetic construct
  misc_feature 1..21: note = n-mer motif encoding polynucleotide
  source 1..21: mol_type = other DNA
cagtcggttaatagtacgagt

SEQ ID NO: 216 - DNA, 21 bp, synthetic construct
  misc_feature 1..21: note = n-mer motif encoding polynucleotide
  source 1..21: mol_type = other DNA
gctctggagagggctcagtat

SEQ ID NO: 217 - DNA, 21 bp, synthetic construct
  misc_feature 1..21: note = n-mer motif encoding polynucleotide
  source 1..21: mol_type = other DNA
catactgggcatagttctgtg

SEQ ID NO: 218 - DNA, 21 bp, synthetic construct
  misc_feature 1..21: note = n-mer motif encoding polynucleotide
  source 1..21: mol_type = other DNA
cggggagacatgacccgagca

SEQ ID NO: 219 - DNA, 21 bp, synthetic construct
  misc_feature 1..21: note = n-mer motif encoding polynucleotide
  source 1..21: mol_type = other DNA
tttcagcgtgatcttgggcat

SEQ ID NO: 220 - DNA, 21 bp, synthetic construct
  misc_feature 1..21: note = n-mer motif encoding polynucleotide
  source 1..21: mol_type = other DNA
acaaccggcgacataatacgc

SEQ ID NO: 221 - DNA, 21 bp, synthetic construct
  misc_feature 1..21: note = n-mer motif encoding polynucleotide
  source 1..21: mol_type = other DNA
tcttttcagacggatcgtgcg

SEQ ID NO: 222 - DNA, 21 bp, synthetic construct
  misc_feature 1..21: note = n-mer motif encoding polynucleotide
  source 1..21: mol_type = other DNA
caatccagcgacggccgagtg

SEQ ID NO: 223 - DNA, 21 bp, synthetic construct
  misc_feature 1..21: note = n-mer motif encoding polynucleotide
  source 1..21: mol_type = other DNA
acttctggggctttgacccgg

SEQ ID NO: 224 - DNA, 21 bp, synthetic construct
  misc_feature 1..21: note = n-mer motif encoding polynucleotide
  source 1..21: mol_type = other DNA
aattcgaatactgtgaatacg

SEQ ID NO: 225 - DNA, 21 bp, synthetic construct
  misc_feature 1..21: note = n-mer motif encoding polynucleotide
  source 1..21: mol_type = other DNA
atctccggtagtagcagtcta

SEQ ID NO: 226 - DNA, 21 bp, synthetic construct
  misc_feature 1..21: note = n-mer motif encoding polynucleotide
  source 1..21: mol_type = other DNA
aacgacaaatcaaccaacgta

SEQ ID NO: 227 - DNA, 21 bp, synthetic construct
  misc_feature 1..21: note = n-mer motif encoding polynucleotide
  source 1..21: mol_type = other DNA
atcgtacttgctcccacatcg

SEQ ID NO: 228 - DNA, 21 bp, synthetic construct
  misc_feature 1..21: note = n-mer motif encoding polynucleotide
  source 1..21: mol_type = other DNA
tcaggcgtcaactacggtgtc

SEQ ID NO: 229 - DNA, 21 bp, synthetic construct
  misc_feature 1..21: note = n-mer motif encoding polynucleotide
  source 1..21: mol_type = other DNA
gtcggcgcccaacgggacccc

SEQ ID NO: 230 - DNA, 21 bp, synthetic construct
  misc_feature 1..21: note = n-mer motif encoding polynucleotide
  source 1..21: mol_type = other DNA
acgggtatgaatagtaataag

SEQ ID NO: 231 - DNA, 21 bp, synthetic construct
  misc_feature 1..21: note = n-mer motif encoding polynucleotide
  source 1..21: mol_type = other DNA
atcgaagcctactcacgagac

SEQ ID NO: 232 - DNA, 21 bp, synthetic construct
  misc_feature 1..21: note = n-mer motif encoding polynucleotide
  source 1..21: mol_type = other DNA
ttacacacaacactaatgccc

SEQ ID NO: 233 - DNA, 21 bp, synthetic construct
  misc_feature 1..21: note = n-mer motif encoding polynucleotide
  source 1..21: mol_type = other DNA
tctgataatcatctgaagact

SEQ ID NO: 234 - DNA, 21 bp, synthetic construct
  misc_feature 1..21: note = n-mer motif encoding polynucleotide
  source 1..21: mol_type = other DNA
cgaaacgaagacaaaggagga

SEQ ID NO: 235 - DNA, 21 bp, synthetic construct
  misc_feature 1..21: note = n-mer motif encoding polynucleotide
  source 1..21: mol_type = other DNA
acgaagggtgctaatggtact

SEQ ID NO: 236 - DNA, 21 bp, synthetic construct
  misc_feature 1..21: note = n-mer motif encoding polynucleotide
  source 1..21: mol_type = other DNA
gtctacaacggcaacgtagaa

SEQ ID NO: 237 - DNA, 21 bp, synthetic construct
  misc_feature 1..21: note = n-mer motif encoding polynucleotide
  source 1..21: mol_type = other DNA
tcaaacagcggaggcaaccac

SEQ ID NO: 238 - DNA, 21 bp, synthetic construct
  misc_feature 1..21: note = n-mer motif encoding polynucleotide
  source 1..21: mol_type = other DNA
gtagccgcgggaccagaagcg

SEQ ID NO: 239 - DNA, 21 bp, synthetic construct
  misc_feature 1..21: note = n-mer motif encoding polynucleotide
  source 1..21: mol_type = other DNA
acgtctcttagtggtagtgcg

SEQ ID NO: 240 - DNA, 21 bp, synthetic construct
  misc_feature 1..21: note = n-mer motif encoding polynucleotide
  source 1..21: mol_type = other DNA
gttgggctgcagagtaatact

SEQ ID NO: 241 - DNA, 21 bp, synthetic construct
  misc_feature 1..21: note = n-mer motif encoding polynucleotide
  source 1..21: mol_type = other DNA
cacaccgcccacagcgtggac

SEQ ID NO: 242 - DNA, 21 bp, synthetic construct
  misc_feature 1..21: note = n-mer motif encoding polynucleotide
  source 1..21: mol_type = other DNA
aacgtgggaatgagctcaacc

SEQ ID NO: 243 - DNA, 21 bp, synthetic construct
  misc_feature 1..21: note = n-mer motif encoding polynucleotide
  source 1..21: mol_type = other DNA
catgcggatgtgaatgctggg

SEQ ID NO: 244 - DNA, 21 bp, synthetic construct
  misc_feature 1..21: note = n-mer motif encoding polynucleotide
  source 1..21: mol_type = other DNA
aaagcgggacaactagtggaa

SEQ ID NO: 245 - DNA, 21 bp, synthetic construct
  misc_feature 1..21: note = n-mer motif encoding polynucleotide
  source 1..21: mol_type = other DNA
agtacttttagtgtgctgcct

SEQ ID NO: 246 - DNA, 21 bp, synthetic construct
  misc_feature 1..21: note = n-mer motif encoding polynucleotide
  source 1..21: mol_type = other DNA
cctcagtctccgagtcgggtt

SEQ ID NO: 247 - DNA, 21 bp, synthetic construct
  misc_feature 1..21: note = n-mer motif encoding polynucleotide
  source 1..21: mol_type = other DNA
cacaccgccacccttagcagc

SEQ ID NO: 248 - DNA, 21 bp, synthetic construct
  misc_feature 1..21: note = n-mer motif encoding polynucleotide
  source 1..21: mol_type = other DNA
cttccgcgtcatgatcagtat

SEQ ID NO: 249 - DNA, 21 bp, synthetic construct
  misc_feature 1..21: note = n-mer motif encoding polynucleotide
  source 1..21: mol_type = other DNA
caagtgaacaacccactcaca

SEQ ID NO: 250 - DNA, 21 bp, synthetic construct
  misc_feature 1..21: note = n-mer motif encoding polynucleotide
  source 1..21: mol_type = other DNA
acaacagaaaccgcacgaggt

SEQ ID NO: 251 - DNA, 21 bp, synthetic construct
  misc_feature 1..21: note = n-mer motif encoding polynucleotide
  source 1..21: mol_type = other DNA
gttcatgggacgttgacttat

SEQ ID NO: 252 - DNA, 21 bp, synthetic construct
  misc_feature 1..21: note = n-mer motif encoding polynucleotide
  source 1..21: mol_type = other DNA
tatagtactgatcttaggatg

SEQ ID NO: 253 - DNA, 21 bp, synthetic construct
  misc_feature 1..21: note = n-mer motif encoding polynucleotide
  source 1..21: mol_type = other DNA
gcacacgctacctcaagcact

SEQ ID NO: 254 - DNA, 21 bp, synthetic construct
  misc_feature 1..21: note = n-mer motif encoding polynucleotide
  source 1..21: mol_type = other DNA
agggagagtgctgctctggcg

SEQ ID NO: 255 - DNA, 21 bp, synthetic construct
  misc_feature 1..21: note = n-mer motif encoding polynucleotide
  source 1..21: mol_type = other DNA
aaggatactaatcagcagatt

SEQ ID NO: 256 - DNA, 21 bp, synthetic construct
  misc_feature 1..21: note = n-mer motif encoding polynucleotide
  source 1..21: mol_type = other DNA
agtatgcaatcatacaccatg

SEQ ID NO: 257 - DNA, 21 bp, synthetic construct
  misc_feature 1..21: note = n-mer motif encoding polynucleotide
  source 1..21: mol_type = other DNA
acagcctactcgcccacagtc

SEQ ID NO: 258 - DNA, 21 bp, synthetic construct
  misc_feature 1..21: note = n-mer motif encoding polynucleotide
  source 1..21: mol_type = other DNA
gaatctgcccaccaaagaata

SEQ ID NO: 259 - DNA, 21 bp, synthetic construct
  misc_feature 1..21: note = n-mer motif encoding polynucleotide
  source 1..21: mol_type = other DNA
agatacacaacagcacaacaa

SEQ ID NO: 260 - DNA, 21 bp, synthetic construct
  misc_feature 1..21: note = n-mer motif encoding polynucleotide
  source 1..21: mol_type = other DNA
acgtctgtggcgaatgtgagt

SEQ ID NO: 261 - DNA, 21 bp, synthetic construct
  misc_feature 1..21: note = n-mer motif encoding polynucleotide
  source 1..21: mol_type = other DNA
agggatcagcatacttctatt

SEQ ID NO: 262 - DNA, 21 bp, synthetic construct
  misc_feature 1..21: note = n-mer motif encoding polynucleotide
  source 1..21: mol_type = other DNA
tctgttacgtcttctggtccg

SEQ ID NO: 263 - DNA, 21 bp, synthetic construct
  misc_feature 1..21: note = n-mer motif encoding polynucleotide
  source 1..21: mol_type = other DNA
gcggttgttctgaatagtaat

SEQ ID NO: 264 - DNA, 21 bp, synthetic construct
  misc_feature 1..21: note = n-mer motif encoding polynucleotide
  source 1..21: mol_type = other DNA
cctgggaatccgtctagtaat

SEQ ID NO: 265 - DNA, 21 bp, synthetic construct
  misc_feature 1..21: note = n-mer motif encoding polynucleotide
  source 1..21: mol_type = other DNA
acggggtctactactcagctt

SEQ ID NO: 266 - DNA, 21 bp, synthetic construct
  misc_feature 1..21: note = n-mer motif encoding polynucleotide
  source 1..21: mol_type = other DNA
gctaatgagcataatgtgggt

SEQ ID NO: 267 - DNA, 21 bp, synthetic construct
  misc_feature 1..21: note = n-mer motif encoding polynucleotide
  source 1..21: mol_type = other DNA
atgcaaagagaagcagccaac

SEQ ID NO: 268 - DNA, 21 bp, synthetic construct
  misc_feature 1..21: note = n-mer motif encoding polynucleotide
  source 1..21: mol_type = other DNA
ttaaccgacacaaacacccgg

SEQ ID NO: 269 - DNA, 21 bp, synthetic construct
  misc_feature 1..21: note = n-mer motif encoding polynucleotide
  source 1..21: mol_type = other DNA
cgaatgaccgaaatatcatac

SEQ ID NO: 270 - DNA, 21 bp, synthetic construct
  misc_feature 1..21: note = n-mer motif encoding polynucleotide
  source 1..21: mol_type = other DNA
aaagtggacatgacctccaaa

SEQ ID NO: 271 - DNA, 21 bp, synthetic construct
  misc_feature 1..21: note = n-mer motif encoding polynucleotide
  source 1..21: mol_type = other DNA
agaggagacttatccacaccc

SEQ ID NO: 272 - DNA, 21 bp, synthetic construct
  misc_feature 1..21: note = n-mer motif encoding polynucleotide
  source 1..21: mol_type = other DNA
caagcaaaagctagcacaact

SEQ ID NO: 273 - DNA, 21 bp, synthetic construct
  misc_feature 1..21: note = n-mer motif encoding polynucleotide
  source 1..21: mol_type = other DNA
ctaccctcaacagaaactttg

SEQ ID NO: 274 - DNA, 21 bp, synthetic construct
  misc_feature 1..21: note = n-mer motif encoding polynucleotide
  source 1..21: mol_type = other DNA
agtagtgcgcttaatgcgtat

SEQ ID NO: 275 - DNA, 21 bp, synthetic construct
  misc_feature 1..21: note = n-mer motif encoding polynucleotide
  source 1..21: mol_type = other DNA
tcgtctgatcctaaggggcag

SEQ ID NO: 276 - DNA, 21 bp, synthetic construct
  misc_feature 1..21: note = n-mer motif encoding polynucleotide
  source 1..21: mol_type = other DNA
ttagacgtgacgagaatgaga

SEQ ID NO: 277 - DNA, 21 bp, synthetic construct
  misc_feature 1..21: note = n-mer motif encoding polynucleotide
  source 1..21: mol_type = other DNA
gcggatggtggtgataagggg

SEQ ID NO: 278 - DNA, 21 bp, synthetic construct
  misc_feature 1..21: note = n-mer motif encoding polynucleotide
  source 1..21: mol_type = other DNA
atgctgtctcaggttacgttg

SEQ ID NO: 279 - DNA, 21 bp, synthetic construct
  misc_feature 1..21: note = n-mer motif encoding polynucleotide
  source 1..21: mol_type = other DNA
agtgttagttctgtggtgttg

SEQ ID NO: 280 - DNA, 21 bp, synthetic construct
  misc_feature 1..21: note = n-mer motif encoding polynucleotide
  source 1..21: mol_type = other DNA
accgaatcgcaaaccatgagg

SEQ ID NO: 281 - DNA, 21 bp, synthetic construct
  misc_feature 1..21: note = n-mer motif encoding polynucleotide
  source 1..21: mol_type = other DNA
ttcggatcccaagaaaaactc

SEQ ID NO: 282 - DNA, 21 bp, synthetic construct
  misc_feature 1..21: note = n-mer motif encoding polynucleotide
  source 1..21: mol_type = other DNA
acagccggcggcgaacgcgcc

SEQ ID NO: 283 - DNA, 21 bp, synthetic construct
  misc_feature 1..21: note = n-mer motif encoding polynucleotide
  source 1..21: mol_type = other DNA
gatcatagtaagcagagttcg

SEQ ID NO: 284 - DNA, 21 bp, synthetic construct
  misc_feature 1..21: note = n-mer motif encoding polynucleotide
  source 1..21: mol_type = other DNA
attgatagtacttggaatacg

SEQ ID NO: 285 - DNA, 21 bp, synthetic construct
  misc_feature 1..21: note = n-mer motif encoding polynucleotide
  source 1..21: mol_type = other DNA
tcgcctcgccccgaactccga

SEQ ID NO: 286 - DNA, 21 bp, synthetic construct
  misc_feature 1..21: note = n-mer motif encoding polynucleotide
  source 1..21: mol_type = other DNA
agtattgcgactgctactagt

SEQ ID NO: 287 - DNA, 21 bp, synthetic construct
  misc_feature 1..21: note = n-mer motif encoding polynucleotide
  source 1..21: mol_type = other DNA
gtaataggcggacacgggact

SEQ ID NO: 288 - DNA, 21 bp, synthetic construct
  misc_feature 1..21: note = n-mer motif encoding polynucleotide
  source 1..21: mol_type = other DNA
agcaccgccatgtacccccac

SEQ ID NO: 289 - DNA, 21 bp, synthetic construct
  misc_feature 1..21: note = n-mer motif encoding polynucleotide
  source 1..21: mol_type = other DNA
cgggacttgagacccgtgacg

SEQ ID NO: 290 - DNA, 21 bp, synthetic construct
  misc_feature 1..21: note = n-mer motif encoding polynucleotide
  source 1..21: mol_type = other DNA
gctcatctgactgatcttccg

SEQ ID NO: 291 - DNA, 21 bp, synthetic construct
  misc_feature 1..21: note = n-mer motif encoding polynucleotide
  source 1..21: mol_type = other DNA
tttctgaatagtacgcagctt

SEQ ID NO: 292 - DNA, 21 bp, synthetic construct
  misc_feature 1..21: note = n-mer motif encoding polynucleotide
  source 1..21: mol_type = other DNA
ttaaacaacagtgccacagtc

SEQ ID NO: 293 - DNA, 21 bp, synthetic construct
  misc_feature 1..21: note = n-mer motif encoding polynucleotide
  source 1..21: mol_type = other DNA
gatcgtccgaataatatgacg

SEQ ID NO: 294 - DNA, 21 bp, synthetic construct
  misc_feature 1..21: note = n-mer motif encoding polynucleotide
  source 1..21: mol_type = other DNA
tcatcgtcagactcacccaga

SEQ ID NO: 295 - DNA, 21 bp, synthetic construct
  misc_feature 1..21: note = n-mer motif encoding polynucleotide
  source 1..21: mol_type = other DNA
cgcttggacgttggaagcccg

SEQ ID NO: 296 - DNA, 21 bp, synthetic construct
  misc_feature 1..21: note = n-mer motif encoding polynucleotide
  source 1..21: mol_type = other DNA
gcgcagcagagtcttcatggt

SEQ ID NO: 297 - DNA, 21 bp, synthetic construct
  misc_feature 1..21: note = n-mer motif encoding polynucleotide
  source 1..21: mol_type = other DNA
atggggaagcatgagggtctt

SEQ ID NO: 298 - DNA, 21 bp, synthetic construct
  misc_feature 1..21: note = n-mer motif encoding polynucleotide
  source 1..21: mol_type = other DNA
gagaatgctcgtgagggtgtg

SEQ ID NO: 299 - DNA, 21 bp, synthetic construct
  misc_feature 1..21: note = n-mer motif encoding polynucleotide
  source 1..21: mol_type = other DNA
accgtatctctctcggaaggc

SEQ ID NO: 300 - DNA, 21 bp, synthetic construct
  misc_feature 1..21: note = n-mer motif encoding polynucleotide
  source 1..21: mol_type = other DNA
cttaacacactaatcgaccgg

SEQ ID NO: 301 - DNA, 21 bp, synthetic construct
  misc_feature 1..21: note = n-mer motif encoding polynucleotide
  source 1..21: mol_type = other DNA
gaactctccgttccgaaacca

SEQ ID NO: 302 - DNA, 21 bp, synthetic construct
  misc_feature 1..21: note = n-mer motif encoding polynucleotide
  source 1..21: mol_type = other DNA
aaagacaaaaacgtatacata

SEQ ID NO: 303 - DNA, 21 bp, synthetic construct
  misc_feature 1..21: note = n-mer motif encoding polynucleotide
  source 1..21: mol_type = other DNA
aatgcgaatgggcctgtgagt

SEQ ID NO: 304 - DNA, 21 bp, synthetic construct
  misc_feature 1..21: note = n-mer motif encoding polynucleotide
  source 1..21: mol_type = other DNA
cttactacgaatggtatgctg

SEQ ID NO: 305 - DNA, 21 bp, synthetic construct
  misc_feature 1..21: note = n-mer motif encoding polynucleotide
  source 1..21: mol_type = other DNA
gccggcgaatcttcacccaca

SEQ ID NO: 306 - DNA, 21 bp, synthetic construct
  misc_feature 1..21: note = n-mer motif encoding polynucleotide
  source 1..21: mol_type = other DNA
agtgggattggtacttattct

SEQ ID NO: 307 - DNA, 21 bp, synthetic construct
  misc_feature 1..21: note = n-mer motif encoding polynucleotide
  source 1..21: mol_type = other DNA
gtcagatctatggacgaattg

SEQ ID NO: 308 - DNA, 21 bp, synthetic construct
  misc_feature 1..21: note = n-mer motif encoding polynucleotide
  source 1..21: mol_type = other DNA
atgaacaccggctcttcgagt

SEQ ID NO: 309 - DNA, 21 bp, synthetic construct
  misc_feature 1..21: note = n-mer motif encoding polynucleotide
  source 1..21: mol_type = other DNA
ggggtgactgttagggagctt

SEQ ID NO: 310 - DNA, 21 bp, synthetic construct
  misc_feature 1..21: note = n-mer motif encoding polynucleotide
  source 1..21: mol_type = other DNA
cagattttgaattatagtgtg

SEQ ID NO: 311 - DNA, 21 bp, synthetic construct
  misc_feature 1..21: note = n-mer motif encoding polynucleotide
  source 1..21: mol_type = other DNA
atggcgggtgagtatagggtt

SEQ ID NO: 312 - DNA, 21 bp, synthetic construct
  misc_feature 1..21: note = n-mer motif encoding polynucleotide
  source 1..21: mol_type = other DNA
tggtcgcatgatcggcctact

SEQ ID NO: 313 - DNA, 21 bp, synthetic construct
  misc_feature 1..21: note = n-mer motif encoding polynucleotide
  source 1..21: mol_type = other DNA
tgcaaaaacaactcagaatgc

SEQ ID NO: 314 - DNA, 21 bp, synthetic construct
  misc_feature 1..21: note = n-mer motif encoding polynucleotide
  source 1..21: mol_type = other DNA
ttgacgacgaatagtcattat

SEQ ID NO: 315 - DNA, 21 bp, synthetic construct
  misc_feature 1..21: note = n-mer motif encoding polynucleotide
  source 1..21: mol_type = other DNA
atgcttgttcagaatactcct

SEQ ID NO: 316 - DNA, 21 bp, synthetic construct
  misc_feature 1..21: note = n-mer motif encoding polynucleotide
  source 1..21: mol_type = other DNA
cgtggtgcgactgagcatgcg

SEQ ID NO: 317 - DNA, 21 bp, synthetic construct
  misc_feature 1..21: note = n-mer motif encoding polynucleotide
  source 1..21: mol_type = other DNA
gcttcgaatgggagtatgggt

SEQ ID NO: 318 - DNA, 21 bp, synthetic construct
  misc_feature 1..21: note = n-mer motif encoding polynucleotide
  source 1..21: mol_type = other DNA
aatagttatactgctgggaag

SEQ ID NO: 319 - DNA, 21 bp, synthetic construct
  misc_feature 1..21: note = n-mer motif encoding polynucleotide
  source 1..21: mol_type = other DNA
tccacccaaggagccatcctc

SEQ ID NO: 320 - DNA, 21 bp, synthetic construct
  misc_feature 1..21: note = n-mer motif encoding polynucleotide
  source 1..21: mol_type = other DNA
tggaatacgaatatggcgatt

SEQ ID NO: 321 - DNA, 21 bp, synthetic construct
  misc_feature 1..21: note = n-mer motif encoding polynucleotide
  source 1..21: mol_type = other DNA
gtctcatcgtacgaaaaaata

SEQ ID NO: 322 - DNA, 21 bp, synthetic construct
  misc_feature 1..21: note = n-mer motif encoding polynucleotide
  source 1..21: mol_type = other DNA
gtgctgagtacggggcagcgg

SEQ ID NO: 323 - DNA, 21 bp, synthetic construct
  misc_feature 1..21: note = n-mer motif encoding polynucleotide
  source 1..21: mol_type = other DNA
cctataccccacggttcatcc

SEQ ID NO: 324 - DNA, 21 bp, synthetic construct
  misc_feature 1..21: note = n-mer motif encoding polynucleotide
  source 1..21: mol_type = other DNA
aacgtgtcactaacgcaaacg

SEQ ID NO: 325 - DNA, 21 bp, synthetic construct
  misc_feature 1..21: note = n-mer motif encoding polynucleotide
  source 1..21: mol_type = other DNA
tctaccatcggcaacagcacg

SEQ ID NO: 326 - DNA, 21 bp, synthetic construct
  misc_feature 1..21: note = n-mer motif encoding polynucleotide
  source 1..21: mol_type = other DNA
tctgagaagctgactgataag

SEQ ID NO: 327 - DNA, 21 bp, synthetic construct
  misc_feature 1..21: note = n-mer motif encoding polynucleotide
  source 1..21: mol_type = other DNA
tccaaagactcgaacataagt

SEQ ID NO: 328 - DNA, 21 bp, synthetic construct
  misc_feature 1..21: note = n-mer motif encoding polynucleotide
  source 1..21: mol_type = other DNA
gcgaatagtaatcatgagcgt

SEQ ID NO: 329 - DNA, 21 bp, synthetic construct
  misc_feature 1..21: note = n-mer motif encoding polynucleotide
  source 1..21: mol_type = other DNA
agggatacgggtgataaggct

SEQ ID NO: 330 - DNA, 21 bp, synthetic construct
  misc_feature 1..21: note = n-mer motif encoding polynucleotide
  source 1..21: mol_type = other DNA
agaacagacacgccgtcaacc

SEQ ID NO: 331 - DNA, 21 bp, synthetic construct
  misc_feature 1..21: note = n-mer motif encoding polynucleotide
  source 1..21: mol_type = other DNA
cctactatgtcgagtctgaat

SEQ ID NO: 332 - DNA, 21 bp, synthetic construct
  misc_feature 1..21: note = n-mer motif encoding polynucleotide
  source 1..21: mol_type = other DNA
gatattactaatcagtcgtat

SEQ ID NO: 333 - DNA, 21 bp, synthetic construct
  misc_feature 1..21: note = n-mer motif encoding polynucleotide
  source 1..21: mol_type = other DNA
cttgtaaaaccggaaacttgg

SEQ ID NO: 334 - DNA, 21 bp, synthetic construct
  misc_feature 1..21: note = n-mer motif encoding polynucleotide
  source 1..21: mol_type = other DNA
gggacttccttggaaaaccga

SEQ ID NO: 335 - DNA, 21 bp, synthetic construct
  misc_feature 1..21: note = n-mer motif encoding polynucleotide
  source 1..21: mol_type = other DNA
gctgctggtaatcctactcgt

SEQ ID NO: 336 - DNA, 21 bp, synthetic construct
  misc_feature 1..21: note = n-mer motif encoding polynucleotide
  source 1..21: mol_type = other DNA
cacaacgtcggcctaggacac

SEQ ID NO: 337 - DNA, 21 bp, synthetic construct
  misc_feature 1..21: note = n-mer motif encoding polynucleotide
  source 1..21: mol_type = other DNA
gtatcaacgacaacggaccgg

SEQ ID NO: 338 - DNA, 21 bp, synthetic construct
  misc_feature 1..21: note = n-mer motif encoding polynucleotide
  source 1..21: mol_type = other DNA
tatttgtcgtctggtaagatg

SEQ ID NO: 339 - DNA, 21 bp, synthetic construct
  misc_feature 1..21: note = n-mer motif encoding polynucleotide
  source 1..21: mol_type = other DNA
gatagtcggaatgctgctttg

SEQ ID NO: 340 - DNA, 21 bp, synthetic construct
  misc_feature 1..21: note = n-mer motif encoding polynucleotide
  source 1..21: mol_type = other DNA
gtggagcggaatactgatatg

SEQ ID NO: 341 - DNA, 21 bp, synthetic construct
  misc_feature 1..21: note = n-mer motif encoding polynucleotide
  source 1..21: mol_type = other DNA
actgttgggagtaattctatt

SEQ ID NO: 342 - DNA, 21 bp, synthetic construct
  misc_feature 1..21: note = n-mer motif encoding polynucleotide
  source 1..21: mol_type = other DNA
gtgcggtctggtaataagccg

SEQ ID NO: 343 - DNA, 21 bp, synthetic construct
  misc_feature 1..21: note = n-mer motif encoding polynucleotide
  source 1..21: mol_type = other DNA
ggcagttcggggaacagcgga

SEQ ID NO: 344 - DNA, 21 bp, synthetic construct
  misc_feature 1..21: note = n-mer motif encoding polynucleotide
  source 1..21: mol_type = other DNA
tctacttcaataggagtggta

SEQ ID NO: 345 - DNA, 21 bp, synthetic construct
  misc_feature 1..21: note = n-mer motif encoding polynucleotide
  source 1..21: mol_type = other DNA
ccgagtcagagtaggtcgctt

SEQ ID NO: 346 - DNA, 21 bp, synthetic construct
  misc_feature 1..21: note = n-mer motif encoding polynucleotide
  source 1..21: mol_type = other DNA
cggaatgagaatcttaataat

SEQ ID NO: 347 - DNA, 21 bp, synthetic construct
  misc_feature 1..21: note = n-mer motif encoding polynucleotide
  source 1..21: mol_type = other DNA
tcgttgggtaagagggaggag

SEQ ID NO: 348 - DNA, 21 bp, synthetic construct
  misc_feature 1..21: note = n-mer motif encoding polynucleotide
  source 1..21: mol_type = other DNA
tcacgcttggactcgagctcc

SEQ ID NO: 349 - DNA, 21 bp, synthetic construct
  misc_feature 1..21: note = n-mer motif encoding polynucleotide
  source 1..21: mol_type = other DNA
gattcgacgtatgttttggct

SEQ ID NO: 350 - DNA, 21 bp, synthetic construct
  misc_feature 1..21: note = n-mer motif encoding polynucleotide
  source 1..21: mol_type = other DNA
gagcgtaatcctatttctgat

SEQ ID NO: 351 - DNA, 21 bp, synthetic construct
  misc_feature 1..21: note = n-mer motif encoding polynucleotide
  source 1..21: mol_type = other DNA
gttagctccggccacacgaaa

SEQ ID NO: 352 - DNA, 21 bp, synthetic construct
  misc_feature 1..21: note = n-mer motif encoding polynucleotide
  source 1..21: mol_type = other DNA
aagtatacggagtcgaatgcg

SEQ ID NO: 353 - DNA, 21 bp, synthetic construct
  misc_feature 1..21: note = n-mer motif encoding polynucleotide
  source 1..21: mol_type = other DNA
aaccgcaactcagttgggact

SEQ ID NO: 354 - DNA, 21 bp, synthetic construct
  misc_feature 1..21: note = n-mer motif encoding polynucleotide
  source 1..21: mol_type = other DNA
cacgaaagccactacgtgtca

SEQ ID NO: 355 - DNA, 21 bp, synthetic construct
  misc_feature 1..21: note = n-mer motif encoding polynucleotide
  source 1..21: mol_type = other DNA
acgactggggggacggggatg

SEQ ID NO: 356 - DNA, 21 bp, synthetic construct
  misc_feature 1..21: note = n-mer motif encoding polynucleotide
  source 1..21: mol_type = other DNA
gcgactgataagatgactcct

SEQ ID NO: 357 - DNA, 21 bp, synthetic construct
  misc_feature 1..21: note = n-mer motif encoding polynucleotide
  source 1..21: mol_type = other DNA
tccgcgtctagcggcgctaca

SEQ ID NO: 358 - DNA, 21 bp, synthetic construct
  misc_feature 1..21: note = n-mer motif encoding polynucleotide
  source 1..21: mol_type = other DNA
tcaaccactactggccacatg

SEQ ID NO: 359 - DNA, 21 bp, synthetic construct
  misc_feature 1..21: note = n-mer motif encoding polynucleotide
  source 1..21: mol_type = other DNA
ataatagcatcctctaccacg

SEQ ID NO: 360 - DNA, 21 bp, synthetic construct
  misc_feature 1..21: note = n-mer motif encoding polynucleotide
  source 1..21: mol_type = other DNA
gatactgggtctaggattgcg

SEQ ID NO: 361 - DNA, 21 bp, synthetic construct
  misc_feature 1..21: note = n-mer motif encoding polynucleotide
  source 1..21: mol_type = other DNA
tgggctgatgattcgcagcgg

SEQ ID NO: 362 - DNA, 21 bp, synthetic construct
  misc_feature 1..21: note = n-mer motif encoding polynucleotide
  source 1..21: mol_type = other DNA
aggggtaacactctcgaaatg

SEQ ID NO: 363 - DNA, 21 bp, synthetic construct
  misc_feature 1..21: note = n-mer motif encoding polynucleotide
  source 1..21: mol_type = other DNA
aatctgcaggtgaatgcgaat

SEQ ID NO: 364 - DNA, 21 bp, synthetic construct
  misc_feature 1..21: note = n-mer motif encoding polynucleotide
  source 1..21: mol_type = other DNA
gcgacgactcagctgatgact

SEQ ID NO: 365 - DNA, 21 bp, synthetic construct
  misc_feature 1..21: note = n-mer motif encoding polynucleotide
  source 1..21: mol_type = other DNA
gctgatacgaatattattgtg

SEQ ID NO: 366 - DNA, 21 bp, synthetic construct
  misc_feature 1..21: note = n-mer motif encoding polynucleotide
  source 1..21: mol_type = other DNA
gccataacaatcactcaaaaa

SEQ ID NO: 367 - DNA, 21 bp, synthetic construct
  misc_feature 1..21: note = n-mer motif encoding polynucleotide
  source 1..21: mol_type = other DNA
gactccaacaaaggagcgacg

SEQ ID NO: 368 - DNA, 21 bp, synthetic construct
  misc_feature 1..21: note = n-mer motif encoding polynucleotide
  source 1..21: mol_type = other DNA
ggcaacgcttccggaaaccca

SEQ ID NO: 369 - DNA, 21 bp, synthetic construct
  misc_feature 1..21: note = n-mer motif encoding polynucleotide
  source 1..21: mol_type = other DNA
acgatgggtgctaaaggtact

SEQ ID NO: 370 - DNA, 21 bp, synthetic construct
  misc_feature 1..21: note = n-mer motif encoding polynucleotide
  source 1..21: mol_type = other DNA
tatctgcagacgggtactctg

SEQ ID NO: 371 - DNA, 21 bp, synthetic construct
  misc_feature 1..21: note = n-mer motif encoding polynucleotide
  source 1..21: mol_type = other DNA
gcattacacaccaaagaccta

SEQ ID NO: 372 - DNA, 21 bp, synthetic construct
  misc_feature 1..21: note = n-mer motif encoding polynucleotide
  source 1..21: mol_type = other DNA
gtcgacaaaagcgaagccgtc

SEQ ID NO: 373 - DNA, 21 bp, synthetic construct
  misc_feature 1..21: note = n-mer motif encoding polynucleotide
  source 1..21: mol_type = other DNA
gggaggacggatcttatggcg

SEQ ID NO: 374 - DNA, 21 bp, synthetic construct
  misc_feature 1..21: note = n-mer motif encoding polynucleotide
  source 1..21: mol_type = other DNA
ggcacggaaccgcgcactgca

SEQ ID NO: 375 - DNA, 21 bp, synthetic construct
  misc_feature 1..21: note = n-mer motif encoding polynucleotide
  source 1..21: mol_type = other DNA
agaggcgacatgtcacgagaa

SEQ ID NO: 376 - DNA, 21 bp, synthetic construct
  misc_feature 1..21: note = n-mer motif encoding polynucleotide
  source 1..21: mol_type = other DNA
cggggggatactaagtctaag

SEQ ID NO: 377 - DNA, 21 bp, synthetic construct
  misc_feature 1..21: note = n-mer motif encoding polynucleotide
  source 1..21: mol_type = other DNA
gggacattagcctcaatgtcc

SEQ ID NO: 378 - DNA, 21 bp, synthetic construct
  misc_feature 1..21: note = n-mer motif encoding polynucleotide
  source 1..21: mol_type = other DNA
cagaagtctgtgacgtattcg

SEQ ID NO: 379 - DNA, 21 bp, synthetic construct
  misc_feature 1..21: note = n-mer motif encoding polynucleotide
  source 1..21: mol_type = other DNA
agtacggggcagactcttgtt

SEQ ID NO: 380 - DNA, 21 bp, synthetic construct
  misc_feature 1..21: note = n-mer motif encoding polynucleotide
  source 1..21: mol_type = other DNA
tcgcacataaacatggggtcg

SEQ ID NO: 381 - DNA, 21 bp, synthetic construct
  misc_feature 1..21: note = n-mer motif encoding polynucleotide
  source 1..21: mol_type = other DNA
gcgttgaatggtactggtaat

SEQ ID NO: 382 - DNA, 21 bp, synthetic construct
  misc_feature 1..21: note = n-mer motif encoding polynucleotide
  source 1..21: mol_type = other DNA
actacgagttcgaatcagcat

SEQ ID NO: 383 - DNA, 21 bp, synthetic construct
  misc_feature 1..21: note = n-mer motif encoding polynucleotide
  source 1..21: mol_type = other DNA
aaaaactacgcaagcaccgac

SEQ ID NO: 384 - DNA, 21 bp, synthetic construct
  misc_feature 1..21: note = n-mer motif encoding polynucleotide
  source 1..21: mol_type = other DNA
gaatccacaagcaggacgtac

SEQ ID NO: 385 - DNA, 21 bp, synthetic construct
  misc_feature 1..21: note = n-mer motif encoding polynucleotide
  source 1..21: mol_type = other DNA
ccgcgttctattacggagttg

SEQ ID NO: 386 - DNA, 21 bp, synthetic construct
  misc_feature 1..21: note = n-mer motif encoding polynucleotide
  source 1..21: mol_type = other DNA
tacatagccggaggagaaaaa

SEQ ID NO: 387 - DNA, 21 bp, synthetic construct
  misc_feature 1..21: note = n-mer motif encoding polynucleotide
  source 1..21: mol_type = other DNA
actagtaattatatgcatgag

SEQ ID NO: 388 - DNA, 21 bp, synthetic construct
  misc_feature 1..21: note = n-mer motif encoding polynucleotide
  source 1..21: mol_type = other DNA
ttggatcctaatagtactcgg

SEQ ID NO: 389 - DNA, 21 bp, synthetic construct
  misc_feature 1..21: note = n-mer motif encoding polynucleotide
  source 1..21: mol_type = other DNA
cacagtgacatgggctcaagc

SEQ ID NO: 390 - DNA, 21 bp, synthetic construct
  misc_feature 1..21: note = n-mer motif encoding polynucleotide
  source 1..21: mol_type = other DNA
gacaccgccaaccgatccaca

SEQ ID NO: 391 - DNA, 21 bp, synthetic construct
  misc_feature 1..21: note = n-mer motif encoding polynucleotide
  source 1..21: mol_type = other DNA
aacgccggacacagcggtcaa

SEQ ID NO: 392 - DNA, 21 bp, synthetic construct
  misc_feature 1..21: note = n-mer motif encoding polynucleotide
  source 1..21: mol_type = other DNA
agtttggggtcggatcgtatg

SEQ ID NO: 393 - DNA, 21 bp, synthetic construct
  misc_feature 1..21: note = n-mer motif encoding polynucleotide
  source 1..21: mol_type = other DNA
gacaaccaacaagccctagct

SEQ ID NO: 394 - DNA, 21 bp, synthetic construct
  misc_feature 1..21: note = n-mer motif encoding polynucleotide
  source 1..21: mol_type = other DNA
ccatcctcagcgggtagcaca

SEQ ID NO: 395 - DNA, 21 bp, synthetic construct
  misc_feature 1..21: note = n-mer motif encoding polynucleotide
  source 1..21: mol_type = other DNA
gacaggaaagggtacgacgca

SEQ ID NO: 396 - DNA, 21 bp, synthetic construct
  misc_feature 1..21: note = n-mer motif encoding polynucleotide
  source 1..21: mol_type = other DNA
ggaggaaaccaaaaccttact

SEQ ID NO: 397 - DNA, 21 bp, synthetic construct
  misc_feature 1..21: note = n-mer motif encoding polynucleotide
  source 1..21: mol_type = other DNA
gtgaatctgaatgagacggag

SEQ ID NO: 398 - DNA, 21 bp, synthetic construct
  misc_feature 1..21: note = n-mer motif encoding polynucleotide
  source 1..21: mol_type = other DNA
tcccccggcaacgggttgcta

SEQ ID NO: 399 - DNA, 21 bp, synthetic construct
  misc_feature 1..21: note = n-mer motif encoding polynucleotide
  source 1..21: mol_type = other DNA
tctgtcggggacctcacaaaa

SEQ ID NO: 400 - DNA, 21 bp, synthetic construct
  misc_feature 1..21: note = n-mer motif encoding polynucleotide
  source 1..21: mol_type = other DNA
cgatacgaatccgtcggactc

SEQ ID NO: 401 - DNA, 21 bp, synthetic construct
  misc_feature 1..21: note = n-mer motif encoding polynucleotide
  source 1..21: mol_type = other DNA
acgagagaattgacaaaaaac

SEQ ID NO: 402 - DNA, 21 bp, synthetic construct
  misc_feature 1..21: note = n-mer motif encoding polynucleotide
  source 1..21: mol_type = other DNA
actccaactaacgggaaccct

SEQ ID NO: 403 - DNA, 21 bp, synthetic construct
  misc_feature 1..21: note = n-mer motif encoding polynucleotide
  source 1..21: mol_type = other DNA
gcgactgatcagcgttcgagg

SEQ ID NO: 404 - DNA, 21 bp, synthetic construct
  misc_feature 1..21: note = n-mer motif encoding polynucleotide
  source 1..21: mol_type = other DNA
ggaacatcggcagaatcacgc

SEQ ID NO: 405 - DNA, 21 bp, synthetic construct
  misc_feature 1..21: note = n-mer motif encoding polynucleotide
  source 1..21: mol_type = other DNA
aggatgctctctactttgcct

SEQ ID NO: 406 - DNA, 21 bp, synthetic construct
  misc_feature 1..21: note = n-mer motif encoding polynucleotide
  source 1..21: mol_type = other DNA
ggtatcaactcctcacacttc

SEQ ID NO: 407 - DNA, 21 bp, synthetic construct
  misc_feature 1..21: note = n-mer motif encoding polynucleotide
  source 1..21: mol_type = other DNA
agtagctcaactgaagggcaa

SEQ ID NO: 408 - DNA, 21 bp, synthetic construct
  misc_feature 1..21: note = n-mer motif encoding polynucleotide
  source 1..21: mol_type = other DNA
gacaaacaacaaaccggacaa

SEQ ID NO: 409 - DNA, 21 bp, synthetic construct
  misc_feature 1..21: note = n-mer motif encoding polynucleotide
  source 1..21: mol_type = other DNA
acccaacacctaccatccaca

SEQ ID NO: 410 - DNA, 21 bp, synthetic construct
  misc_feature 1..21: note = n-mer motif encoding polynucleotide
  source 1..21: mol_type = other DNA
ggtctggggcagcctcagttg

SEQ ID NO: 411 - DNA, 21 bp, synthetic construct
  misc_feature 1..21: note = n-mer motif encoding polynucleotide
  source 1..21: mol_type = other DNA
gtgactaatgagagtcgtgct

SEQ ID NO: 412 - DNA, 21 bp, synthetic construct
  misc_feature 1..21: note = n-mer motif encoding polynucleotide
  source 1..21: mol_type = other DNA
ggcaactcgaactaccgagaa

SEQ ID NO: 413 - DNA, 21 bp, synthetic construct
  misc_feature 1..21: note = n-mer motif encoding polynucleotide
  source 1..21: mol_type = other DNA
tggaatgctgagaatagtaag

SEQ ID NO: 414 - DNA, 21 bp, synthetic construct
  misc_feature 1..21: note = n-mer motif encoding polynucleotide
  source 1..21: mol_type = other DNA
cctgggagtcagcgtcaggat

SEQ ID NO: 415 - DNA, 21 bp, synthetic construct
  misc_feature 1..21: note = n-mer motif encoding polynucleotide
  source 1..21: mol_type = other DNA
catacgtattcgcaggctgat

SEQ ID NO: 416 - DNA, 21 bp, synthetic construct
  misc_feature 1..21: note = n-mer motif encoding polynucleotide
  source 1..21: mol_type = other DNA
actgccggcaacctaagaagt

SEQ ID NO: 417 - DNA, 21 bp, synthetic construct
  misc_feature 1..21: note = n-mer motif encoding polynucleotide
  source 1..21: mol_type = other DNA
ggcagacaccttcaatcggac

SEQ ID NO: 418 - DNA, 21 bp, synthetic construct
  misc_feature 1..21: note = n-mer motif encoding polynucleotide
  source 1..21: mol_type = other DNA
aacaacgcacacaccgccact

SEQ ID NO: 419 - DNA, 21 bp, synthetic construct
  misc_feature 1..21: note = n-mer motif encoding polynucleotide
  source 1..21: mol_type = other DNA
agtacgagtcaggagaatagg

SEQ ID NO: 420 - DNA, 21 bp, synthetic construct
  misc_feature 1..21: note = n-mer motif encoding polynucleotide
  source 1..21: mol_type = other DNA
aggggtgatactatgaattat

SEQ ID NO: 421 - DNA, 21 bp, synthetic construct
  misc_feature 1..21: note = n-mer motif encoding polynucleotide
  source 1..21: mol_type = other DNA
ccggttgctactcagcatgcg

SEQ ID NO: 422 - DNA, 21 bp, synthetic construct
  misc_feature 1..21: note = n-mer motif encoding polynucleotide
  source 1..21: mol_type = other DNA
gggcatttgaatgctccgact

SEQ ID NO: 423 - DNA, 21 bp, synthetic construct
  misc_feature 1..21: note = n-mer motif encoding polynucleotide
  source 1..21: mol_type = other DNA
caaatattaaactactcagtc

SEQ ID NO: 424 - DNA, 21 bp, synthetic construct
  misc_feature 1..21: note = n-mer motif encoding polynucleotide
  source 1..21: mol_type = other DNA
caaaaccacgcgtctggtgaa

SEQ ID NO: 425 - DNA, 21 bp, synthetic construct
  misc_feature 1..21: note = n-mer motif encoding polynucleotide
  source 1..21: mol_type = other DNA
ggtttaacagggcgggaacta

SEQ ID NO: 426 - DNA, 21 bp, synthetic construct
  misc_feature 1..21: note = n-mer motif encoding polynucleotide
  source 1..21: mol_type = other DNA
gacgtagccgtgactcaacac

SEQ ID NO: 427 - DNA, 21 bp, synthetic construct
  misc_feature 1..21: note = n-mer motif encoding polynucleotide
  source 1..21: mol_type = other DNA
gcaacttacaccgggcgaaca

SEQ ID NO: 428 - DNA, 21 bp, synthetic construct
  misc_feature 1..21: note = n-mer motif encoding polynucleotide
  source 1..21: mol_type = other DNA
aaagaactacaatggcaacga

SEQ ID NO: 429 - DNA, 21 bp, synthetic construct
  misc_feature 1..21: note = n-mer motif encoding polynucleotide
  source 1..21: mol_type = other DNA
gctagttatagtagtatggtg

SEQ ID NO: 430 - DNA, 21 bp, synthetic construct
  misc_feature 1..21: note = n-mer motif encoding polynucleotide
  source 1..21: mol_type = other DNA
gttattagtcatggggcgctg

SEQ ID NO: 431 - DNA, 21 bp, synthetic construct
  misc_feature 1..21: note = n-mer motif encoding polynucleotide
  source 1..21: mol_type = other DNA
cctatacaccacggttcatcc

SEQ ID NO: 432 - DNA, 21 bp, synthetic construct
  misc_feature 1..21: note = n-mer motif encoding polynucleotide
  source 1..21: mol_type = other DNA
gtggataagaatcatcctttg

SEQ ID NO: 433 - DNA, 21 bp, synthetic construct
  misc_feature 1..21: note = n-mer motif encoding polynucleotide
  source 1..21: mol_type = other DNA
acctcgggtgaccggtacacg

SEQ ID NO: 434 - DNA, 21 bp, synthetic construct
  misc_feature 1..21: note = n-mer motif encoding polynucleotide
  source 1..21: mol_type = other DNA
gggacaaaaagctggcctgtc

SEQ ID NO: 435 - DNA, 21 bp, synthetic construct
  misc_feature 1..21: note = n-mer motif encoding polynucleotide
  source 1..21: mol_type = other DNA
tacaacgcccacgaatcattc

SEQ ID NO: 436 - DNA, 21 bp, synthetic construct
  misc_feature 1..21: note = n-mer motif encoding polynucleotide
  source 1..21: mol_type = other DNA
agagtccacgacactccttca

SEQ ID NO: 437 - DNA, 21 bp, synthetic construct
  misc_feature 1..21: note = n-mer motif encoding polynucleotide
  source 1..21: mol_type = other DNA
gcacaaatcgaatcaggccga

SEQ ID NO: 438 - DNA, 21 bp, synthetic construct
  misc_feature 1..21: note = n-mer motif encoding polynucleotide
  source 1..21: mol_type = other DNA
tggaaggataatatgcggatg

SEQ ID NO: 439 - DNA, 21 bp, synthetic construct
  misc_feature 1..21: note = n-mer motif encoding polynucleotide
  source 1..21: mol_type = other DNA
atgcctagtgaaccaccaggg

SEQ ID NO: 440 - DNA, 21 bp, synthetic construct
  misc_feature 1..21: note = n-mer motif encoding polynucleotide
  source 1..21: mol_type = other DNA
cgtggtgattatccgacgtcg

SEQ ID NO: 441 - DNA, 21 bp, synthetic construct
  misc_feature 1..21: note = n-mer motif encoding polynucleotide
  source 1..21: mol_type = other DNA
tttcataatgagtcttatggg

SEQ ID NO: 442 - DNA, 21 bp, synthetic construct
  misc_feature 1..21: note = n-mer motif encoding polynucleotide
  source 1..21: mol_type = other DNA
ttgaatacgatgattgataag

SEQ ID NO: 443 - DNA, 21 bp, synthetic construct
  misc_feature 1..21: note = n-mer motif encoding polynucleotide
  source 1..21: mol_type = other DNA
tccacactaagccaaggagca

SEQ ID NO: 444 - DNA, 21 bp, synthetic construct
  misc_feature 1..21: note = n-mer motif encoding polynucleotide
  source 1..21: mol_type = other DNA
cctttgcacaacatacctcct

SEQ ID NO: 445 - DNA, 21 bp, synthetic construct
  misc_feature 1..21: note = n-mer motif encoding polynucleotide
  source 1..21: mol_type = other DNA
gcttcgtctacgtttttgcct

SEQ ID NO: 446 - DNA, 21 bp, synthetic construct
  misc_feature 1..21: note = n-mer motif encoding polynucleotide
  source 1..21: mol_type = other DNA
atggaaggaatgggactcgga

SEQ ID NO: 447 - DNA, 21 bp, synthetic construct
  misc_feature 1..21: note = n-mer motif encoding polynucleotide
  source 1..21: mol_type = other DNA
aaggattataagccgtatgct

SEQ ID NO: 448 - DNA, 21 bp, synthetic construct
  misc_feature 1..21: note = n-mer motif encoding polynucleotide
  source 1..21: mol_type = other DNA
aatttgcagtctggtgttcag

SEQ ID NO: 449 - DNA, 21 bp, synthetic construct
  misc_feature 1..21: note = n-mer motif encoding polynucleotide
  source 1..21: mol_type = other DNA
acaactcttagccaacaaagc

SEQ ID NO: 450 - DNA, 21 bp, synthetic construct
  misc_feature 1..21: note = n-mer motif encoding polynucleotide
  source 1..21: mol_type = other DNA
cttatgtcgtctacttcctca

SEQ ID NO: 451 - DNA, 21 bp, synthetic construct
  misc_feature 1..21: note = n-mer motif encoding polynucleotide
  source 1..21: mol_type = other DNA
actggccaaggattctcggca

SEQ ID NO: 452 - DNA, 21 bp, synthetic construct
  misc_feature 1..21: note = n-mer motif encoding polynucleotide
  source 1..21: mol_type = other DNA
tctacaatcggcaacagcacg

SEQ ID NO: 453 - DNA, 21 bp, synthetic construct
  misc_feature 1..21: note = n-mer motif encoding polynucleotide
  source 1..21: mol_type = other DNA
ctgagggcgagtgaggctccg

SEQ ID NO: 454 - DNA, 21 bp, synthetic construct
  misc_feature 1..21: note = n-mer motif encoding polynucleotide
  source 1..21: mol_type = other DNA
cagcctaataatggtaatcat

SEQ ID NO: 455 - DNA, 21 bp, synthetic construct
  misc_feature 1..21: note = n-mer motif encoding polynucleotide
  source 1..21: mol_type = other DNA
tcgtcagacgttaccagacaa

SEQ ID NO: 456 - DNA, 21 bp, synthetic construct
  misc_feature 1..21: note = n-mer motif encoding polynucleotide
  source 1..21: mol_type = other DNA
cggggtgacgcaacagaaatg

SEQ ID NO: 457 - DNA, 21 bp, synthetic construct
  misc_feature 1..21: note = n-mer motif encoding polynucleotide
  source 1..21: mol_type = other DNA
tataggggtagggaggattgg

SEQ ID NO: 458 - DNA, 21 bp, synthetic construct
  misc_feature 1..21: note = n-mer motif encoding polynucleotide
  source 1..21: mol_type = other DNA
agcttgcaacaatcacaattg

SEQ ID NO: 459 - DNA, 21 bp, synthetic construct
  misc_feature 1..21: note = n-mer motif encoding polynucleotide
  source 1..21: mol_type = other DNA
aagccgactgcgaatgattgg

SEQ ID NO: 460 - DNA, 21 bp, synthetic construct
  misc_feature 1..21: note = n-mer motif encoding polynucleotide
  source 1..21: mol_type = other DNA
cgtctgactgatactatgcat

SEQ ID NO: 461 - DNA, 21 bp, synthetic construct
  misc_feature 1..21: note = n-mer motif encoding polynucleotide
  source 1..21: mol_type = other DNA
cttcatgggaattatagtccg

SEQ ID NO: 462 - DNA, 21 bp, synthetic construct
  misc_feature 1..21: note = n-mer motif encoding polynucleotide
  source 1..21: mol_type = other DNA
attccggttggggcgatggct

SEQ ID NO: 463 - DNA, 21 bp, synthetic construct
  misc_feature 1..21: note = n-mer motif encoding polynucleotide
  source 1..21: mol_type = other DNA
ccgaacaccgcctcaaacttc

SEQ ID NO: 464 - DNA, 21 bp, synthetic construct
  misc_feature 1..21: note = n-mer motif encoding polynucleotide
  source 1..21: mol_type = other DNA
acgagtagagaagtcaaaggg

SEQ ID NO: 465 - DNA, 21 bp, synthetic construct
  misc_feature 1..21: note = n-mer motif encoding polynucleotide
  source 1..21: mol_type = other DNA
gacacgtcctccggcaacagg

SEQ ID NO: 466 - DNA, 21 bp, synthetic construct
  misc_feature 1..21: note = n-mer motif encoding polynucleotide
  source 1..21: mol_type = other DNA
gaagcagtaacaagtaaatgg

SEQ ID NO: 467 - DNA, 21 bp, synthetic construct
  misc_feature 1..21: note = n-mer motif encoding polynucleotide
  source 1..21: mol_type = other DNA
ctaatcacagccaccactaac

SEQ ID NO: 468 - DNA, 21 bp, synthetic construct
  misc_feature 1..21: note = n-mer motif encoding polynucleotide
  source 1..21: mol_type = other DNA
gatgggggtcgttcgggtatt

SEQ ID NO: 469 - DNA, 21 bp, synthetic construct
  misc_feature 1..21: note = n-mer motif encoding polynucleotide
  source 1..21: mol_type = other DNA
ttcatggaagtcatgaaaaac

SEQ ID NO: 470 - DNA, 21 bp, synthetic construct
  misc_feature 1..21: note = n-mer motif encoding polynucleotide
  source 1..21: mol_type = other DNA
tcctaccaaaacccaccacca

SEQ ID NO: 471 - DNA, 21 bp, synthetic construct
  misc_feature 1..21: note = n-mer motif encoding polynucleotide
  source 1..21: mol_type = other DNA
actaatgtgacgtttaagctt

SEQ ID NO: 472 - DNA, 21 bp, synthetic construct
  misc_feature 1..21: note = n-mer motif encoding polynucleotide
  source 1..21: mol_type = other DNA
atttctacgcatacgatgacg

SEQ ID NO: 473 - DNA, 21 bp, synthetic construct
  misc_feature 1..21: note = n-mer motif encoding polynucleotide
  source 1..21: mol_type = other DNA
gaaacccaaggagcaagatac

SEQ ID NO: 474 - DNA, 21 bp, synthetic construct
  misc_feature 1..21: note = n-mer motif encoding polynucleotide
  source 1..21: mol_type = other DNA
gcggcttatgagcatgcgcct

SEQ ID NO: 475 - DNA, 21 bp, synthetic construct
  misc_feature 1..21: note = n-mer motif encoding polynucleotide
  source 1..21: mol_type = other DNA
tcaacgaacgaccgtgcgtta

SEQ ID NO: 476 - DNA, 21 bp, synthetic construct
  misc_feature 1..21: note = n-mer motif encoding polynucleotide
  source 1..21: mol_type = other DNA
ttcaccgaacgcgcactccaa

SEQ ID NO: 477 - DNA, 21 bp, synthetic construct
  misc_feature 1..21: note = n-mer motif encoding polynucleotide
  source 1..21: mol_type = other DNA
gtagcgggcttagtcgacata

SEQ ID NO: 478 - DNA, 21 bp, synthetic construct
  misc_feature 1..21: note = n-mer motif encoding polynucleotide
  source 1..21: mol_type = other DNA
agctcggtaactaaccttgca

SEQ ID NO: 479 - DNA, 21 bp, synthetic construct
  misc_feature 1..21: note = n-mer motif encoding polynucleotide
  source 1..21: mol_type = other DNA
gatactactactggtcatctt

SEQ ID NO: 480 - DNA, 21 bp, synthetic construct
  misc_feature 1..21: note = n-mer motif encoding polynucleotide
  source 1..21: mol_type = other DNA
acgcgtaatttgtctgagagt

SEQ ID NO: 481 - DNA, 21 bp, synthetic construct
  misc_feature 1..21: note = n-mer motif encoding polynucleotide
  source 1..21: mol_type = other DNA
caggtgaatgttgggcctggt

SEQ ID NO: 482 - DNA, 21 bp, synthetic construct
  misc_feature 1..21: note = n-mer motif encoding polynucleotide
  source 1..21: mol_type = other DNA
aaacaaacgatgtccgacaca

SEQ ID NO: 483 - DNA, 21 bp, synthetic construct
  misc_feature 1..21: note = n-mer motif encoding polynucleotide
  source 1..21: mol_type = other DNA
atgtcgacaaccagcaaaact

SEQ ID NO: 484 - DNA, 21 bp, synthetic construct
  misc_feature 1..21: note = n-mer motif encoding polynucleotide
  source 1..21: mol_type = other DNA
actacaatagggacaaaccaa

SEQ ID NO: 485 - DNA, 21 bp, synthetic construct
  misc_feature 1..21: note = n-mer motif encoding polynucleotide
  source 1..21: mol_type = other DNA
gggactctgacgccgaatctt

SEQ ID NO: 486 - DNA, 21 bp, synthetic construct
  misc_feature 1..21: note = n-mer motif encoding polynucleotide
  source 1..21: mol_type = other DNA
tttgatagttataatattgtg

SEQ ID NO: 487 - DNA, 21 bp, synthetic construct
  misc_feature 1..21: note = n-mer motif encoding polynucleotide
  source 1..21: mol_type = other DNA
cgtggtgcgcctgagcaagcg

SEQ ID NO: 488 - DNA, 21 bp, synthetic construct
  misc_feature 1..21: note = n-mer motif encoding polynucleotide
  source 1..21: mol_type = other DNA
atcgaaaacgtaaaccacttg

SEQ ID NO: 489 - DNA, 21 bp, synthetic construct
  misc_feature 1..21: note = n-mer motif encoding polynucleotide
  source 1..21: mol_type = other DNA
aggtctctggagagtcaggct

SEQ ID NO: 490 - DNA, 21 bp, synthetic construct
  misc_feature 1..21: note = n-mer motif encoding polynucleotide
  source 1..21: mol_type = other DNA
cagtatacgagtctgagtccg

SEQ ID NO: 491 - DNA, 21 bp, synthetic construct
  misc_feature 1..21: note = n-mer motif encoding polynucleotide
  source 1..21: mol_type = other DNA
acgaagggttataatgatctt

SEQ ID NO: 492 - DNA, 21 bp, synthetic construct
  misc_feature 1..21: note = n-mer motif encoding polynucleotide
  source 1..21: mol_type = other DNA
gtcgcctcgatggtacacaac

SEQ ID NO: 493 - DNA, 21 bp, synthetic construct
  misc_feature 1..21: note = n-mer motif encoding polynucleotide
  source 1..21: mol_type = other DNA
tccacaacccacacctcagca

SEQ ID NO: 494 - DNA, 21 bp, synthetic construct
  misc_feature 1..21: note = n-mer motif encoding polynucleotide
  source 1..21: mol_type = other DNA
cttgcgcacccacaaccaaac

SEQ ID NO: 495 - DNA, 21 bp, synthetic construct
  misc_feature 1..21: note = n-mer motif encoding polynucleotide
  source 1..21: mol_type = other DNA
tcgataaacaacataggcgca

SEQ ID NO: 496 - DNA, 21 bp, synthetic construct
  misc_feature 1..21: note = n-mer motif encoding polynucleotide
  source 1..21: mol_type = other DNA
gctatagactccatcaaaatg

SEQ ID NO: 497 - DNA, 21 bp, synthetic construct
  misc_feature 1..21: note = n-mer motif encoding polynucleotide
  source 1..21: mol_type = other DNA
tctatgtatgggcaggctggg

SEQ ID NO: 498 - DNA, 21 bp, synthetic construct
  misc_feature 1..21: note = n-mer motif encoding polynucleotide
  source 1..21: mol_type = other DNA
gagtatgctaatgctaagact

SEQ ID NO: 499 - DNA, 21 bp, synthetic construct
  misc_feature 1..21: note = n-mer motif encoding polynucleotide
  source 1..21: mol_type = other DNA
tatcgggcttcggatgtggcg

SEQ ID NO: 500 - DNA, 21 bp, synthetic construct
  misc_feature 1..21: note = n-mer motif encoding polynucleotide
  source 1..21: mol_type = other DNA
gttagtttggagagtcggttg

SEQ ID NO: 501 - DNA, 21 bp, synthetic construct
  misc_feature 1..21: note = n-mer motif encoding polynucleotide
  source 1..21: mol_type = other DNA
attgagactagttcgcgttcg

SEQ ID NO: 502 - DNA, 21 bp, synthetic construct
  misc_feature 1..21: note = n-mer motif encoding polynucleotide
  source 1..21: mol_type = other DNA
atgggagtgaaacccgaacaa

SEQ ID NO: 503 - DNA, 21 bp, synthetic construct
  misc_feature 1..21: note = n-mer motif encoding polynucleotide
  source 1..21: mol_type = other DNA
gcgcttccgtctcgtgagcgg

SEQ ID NO: 504 - DNA, 21 bp, synthetic construct
  misc_feature 1..21: note = n-mer motif encoding polynucleotide
  source 1..21: mol_type = other DNA
ggcaccggatcttcagcgcac

SEQ ID NO: 505 - DNA, 21 bp, synthetic construct
  misc_feature 1..21: note = n-mer motif encoding polynucleotide
  source 1..21: mol_type = other DNA
caaacgaacaccaacgacaga

SEQ ID NO: 506 - DNA, 21 bp, synthetic construct
  misc_feature 1..21: note = n-mer motif encoding polynucleotide
  source 1..21: mol_type = other DNA
gtattacactctgtatcagca

SEQ ID NO: 507 - DNA, 21 bp, synthetic construct
  misc_feature 1..21: note = n-mer motif encoding polynucleotide
  source 1..21: mol_type = other DNA
ccttattctgctactgatcgg

SEQ ID NO: 508 - DNA, 21 bp, synthetic construct
  misc_feature 1..21: note = n-mer motif encoding polynucleotide
  source 1..21: mol_type = other DNA
gcaaactccggattacacaac

SEQ ID NO: 509 - DNA, 21 bp, synthetic construct
  misc_feature 1..21: note = n-mer motif encoding polynucleotide
  source 1..21: mol_type = other DNA
tatgagagtactcatgttaat

SEQ ID NO: 510 - DNA, 21 bp, synthetic construct
  misc_feature 1..21: note = n-mer motif encoding polynucleotide
  source 1..21: mol_type = other DNA
aacaacgcactagtaggaagt

SEQ ID NO: 511 - DNA, 21 bp, synthetic construct
  misc_feature 1..21: note = n-mer motif encoding polynucleotide
  source 1..21: mol_type = other DNA
ggtatcaactcctcacacatc

SEQ ID NO: 512 - DNA, 21 bp, synthetic construct
  misc_feature 1..21: note = n-mer motif encoding polynucleotide
  source 1..21: mol_type = other DNA
agtatttctgataagaatcag

SEQ ID NO: 513 - DNA, 21 bp, synthetic construct
  misc_feature 1..21: note = n-mer motif encoding polynucleotide
  source 1..21: mol_type = other DNA
gaccaccaacaagccctagca

SEQ ID NO: 514 - DNA, 21 bp, synthetic construct
  misc_feature 1..21: note = n-mer motif encoding polynucleotide
  source 1..21: mol_type = other DNA
gactctaccaaagccatgcaa

SEQ ID NO: 515 - DNA, 21 bp, synthetic construct
  misc_feature 1..21: note = n-mer motif encoding polynucleotide
  source 1..21: mol_type = other DNA
actattactagtcagtcggtg

SEQ ID NO: 516 - DNA, 21 bp, synthetic construct
  misc_feature 1..21: note = n-mer motif encoding polynucleotide
  source 1..21: mol_type = other DNA
ggcgcccgtacaatcttagac

SEQ ID NO: 517 - DNA, 21 bp, synthetic construct
  misc_feature 1..21: note = n-mer motif encoding polynucleotide
  source 1..21: mol_type = other DNA
gagcatagtcctacgactggt

SEQ ID NO: 518 - DNA, 21 bp, synthetic construct
  misc_feature 1..21: note = n-mer motif encoding polynucleotide
  source 1..21: mol_type = other DNA
gggctcacaggatacccaatg

SEQ ID NO: 519 - DNA, 21 bp, synthetic construct
  misc_feature 1..21: note = n-mer motif encoding polynucleotide
  source 1..21: mol_type = other DNA
acgatggaatccggccgccac

SEQ ID NO: 520 - DNA, 21 bp, synthetic construct
  misc_feature 1..21: note = n-mer motif encoding polynucleotide
  source 1..21: mol_type = other DNA
tctgcgtcgaaagtggaatac

SEQ ID NO: 521 - DNA, 21 bp, synthetic construct
  misc_feature 1..21: note = n-mer motif encoding polynucleotide
  source 1..21: mol_type = other DNA
gataagtctaattatagtatt

SEQ ID NO: 522 - DNA, 21 bp, synthetic construct
  misc_feature 1..21: note = n-mer motif encoding polynucleotide
  source 1..21: mol_type = other DNA
ttcaacgaaactgccgggcga

SEQ ID NO: 523 - DNA, 21 bp, synthetic construct
  misc_feature 1..21: note = n-mer motif encoding polynucleotide
  source 1..21: mol_type = other DNA
caaaaatcggaaacctacact

SEQ ID NO: 524 - DNA, 21 bp, synthetic construct
  misc_feature 1..21: note = n-mer motif encoding polynucleotide
  source 1..21: mol_type = other DNA
gcacttacccgtatgcctaac

SEQ ID NO: 525 - DNA, 21 bp, synthetic construct
  misc_feature 1..21: note = n-mer motif encoding polynucleotide
  source 1..21: mol_type = other DNA
cgtaacggctccgcccaaagc

SEQ ID NO: 526 - DNA, 21 bp, synthetic construct
  misc_feature 1..21: note = n-mer motif encoding polynucleotide
  source 1..21: mol_type = other DNA
gcgagggatacgcctgggatt

SEQ ID NO: 527 - DNA, 21 bp, synthetic construct
  misc_feature 1..21: note = n-mer motif encoding polynucleotide
  source 1..21: mol_type = other DNA
attgttaatgctgagatttat

SEQ ID NO: 528 - DNA, 21 bp, synthetic construct
  misc_feature 1..21: note = n-mer motif encoding polynucleotide
  source 1..21: mol_type = other DNA
cgacaaggcgacttaaaagaa

SEQ ID NO: 529 - DNA, 21 bp, synthetic construct
  misc_feature 1..21: note = n-mer motif encoding polynucleotide
  source 1..21: mol_type = other DNA
cgaaacaacccatcgcacgac

SEQ ID NO: 530 - DNA, 21 bp, synthetic construct
  misc_feature 1..21: note = n-mer motif encoding polynucleotide
  source 1..21: mol_type = other DNA
ctcgcccacaactacttaagc

SEQ ID NO: 531 - DNA, 21 bp, synthetic construct
  misc_feature 1..21: note = n-mer motif encoding polynucleotide
  source 1..21: mol_type = other DNA
aacacccacaacctacaaatg

SEQ ID NO: 532 - DNA, 21 bp, synthetic construct
  misc_feature 1..21: note = n-mer motif encoding polynucleotide
  source 1..21: mol_type = other DNA
cgaggagaccacagcacacag

SEQ ID NO: 533 - DNA, 21 bp, synthetic construct
  misc_feature 1..21: note = n-mer motif encoding polynucleotide
  source 1..21: mol_type = other DNA
ctccacggagtcagcagtata

SEQ ID NO: 534 - DNA, 21 bp, synthetic construct
  misc_feature 1..21: note = n-mer motif encoding polynucleotide
  source 1..21: mol_type = other DNA
ggtattaatcatgtggcgtct

SEQ ID NO: 535 - DNA, 21 bp, synthetic construct
  misc_feature 1..21: note = n-mer motif encoding polynucleotide
  source 1..21: mol_type = other DNA
actgataagcttcagggtgtg

SEQ ID NO: 536 - DNA, 21 bp, synthetic construct
  misc_feature 1..21: note = n-mer motif encoding polynucleotide
  source 1..21: mol_type = other DNA
ggaacctccatagactacgta

SEQ ID NO: 537 - DNA, 21 bp, synthetic construct
  misc_feature 1..21: note = n-mer motif encoding polynucleotide
  source 1..21: mol_type = other DNA
tcgaacactgccccccccccc

SEQ ID NO: 538 - DNA, 21 bp, synthetic construct
  misc_feature 1..21: note = n-mer motif encoding polynucleotide
  source 1..21: mol_type = other DNA
actgctaagagttatgggcct

SEQ ID NO: 539 - DNA, 21 bp, synthetic construct
  misc_feature 1..21: note = n-mer motif encoding polynucleotide
  source 1..21: mol_type = other DNA
gaccaccaacaagcactagct

SEQ ID NO: 540 - DNA, 21 bp, synthetic construct
  misc_feature 1..21: note = n-mer motif encoding polynucleotide
  source 1..21: mol_type = other DNA
acacaagtagtcgcaagaaca

SEQ ID NO: 541 - DNA, 21 bp, synthetic construct
  misc_feature 1..21: note = n-mer motif encoding polynucleotide
  source 1..21: mol_type = other DNA
agtcctcctagtacgtcgggt

SEQ ID NO: 542 - DNA, 21 bp, synthetic construct
  misc_feature 1..21: note = n-mer motif encoding polynucleotide
  source 1..21: mol_type = other DNA
cctatgcgaacaccaccgtac

SEQ ID NO: 543 - DNA, 21 bp, synthetic construct
  misc_feature 1..21: note = n-mer motif encoding polynucleotide
  source 1..21: mol_type = other DNA
gctgctggtaatactactcgt

SEQ ID NO: 544 - DNA, 21 bp, synthetic construct
  misc_feature 1..21: note = n-mer motif encoding polynucleotide
  source 1..21: mol_type = other DNA
agaggcgactaatccacaccc

SEQ ID NO: 545 - DNA, 21 bp, synthetic construct
  misc_feature 1..21: note = n-mer motif encoding polynucleotide
  source 1..21: mol_type = other DNA
ctagcgaaaactgtcgctatc

SEQ ID NO: 546 - DNA, 21 bp, synthetic construct
  misc_feature 1..21: note = n-mer motif encoding polynucleotide
  source 1..21: mol_type = other DNA
tctaaatctgaaaacctgcaa

SEQ ID NO: 547 - DNA, 21 bp, synthetic construct
  misc_feature 1..21: note = n-mer motif encoding polynucleotide
  source 1..21: mol_type = other DNA
actcagacgtcgtatgctacg

SEQ ID NO: 548 - DNA, 21 bp, synthetic construct
  misc_feature 1..21: note = n-mer motif encoding polynucleotide
  source 1..21: mol_type = other DNA
actggggataggacttcggtg

SEQ ID NO: 549 - DNA, 21 bp, synthetic construct
  misc_feature 1..21: note = n-mer motif encoding polynucleotide
  source 1..21: mol_type = other DNA
atatcgcaaggctcgagcctc

SEQ ID NO: 550 - DNA, 21 bp, synthetic construct
  misc_feature 1..21: note = n-mer motif encoding polynucleotide
  source 1..21: mol_type = other DNA
cttgttcagatggggagtgtg

SEQ ID NO: 551 - DNA, 21 bp, synthetic construct
  misc_feature 1..21: note = n-mer motif encoding polynucleotide
  source 1..21: mol_type = other DNA
ttatccgcaacatctacgatg

SEQ ID NO: 552 - DNA, 21 bp, synthetic construct
  misc_feature 1..21: note = n-mer motif encoding polynucleotide
  source 1..21: mol_type = other DNA
caaaaccacaacgaactaaaa

SEQ ID NO: 553 - DNA, 21 bp, synthetic construct
  misc_feature 1..21: note = n-mer motif encoding polynucleotide
  source 1..21: mol_type = other DNA
cgtggtgcgcctgagcatgcg

SEQ ID NO: 554 - DNA, 21 bp, synthetic construct
  misc_feature 1..21: note = n-mer motif encoding polynucleotide
  source 1..21: mol_type = other DNA
tcttctttcggaaaagacaac

SEQ ID NO: 555 - DNA, 21 bp, synthetic construct
  misc_feature 1..21: note = n-mer motif encoding polynucleotide
  source 1..21: mol_type = other DNA
aacgctaacgccggtggaaac

SEQ ID NO: 556 - DNA, 21 bp, synthetic construct
  misc_feature 1..21: note = n-mer motif encoding polynucleotide
  source 1..21: mol_type = other DNA
gatcatcatcctcagagtcgt

SEQ ID NO: 557 - DNA, 21 bp, synthetic construct
  misc_feature 1..21: note = n-mer motif encoding polynucleotide
  source 1..21: mol_type = other DNA
atgaggcatgaggctcctctt

SEQ ID NO: 558 - DNA, 21 bp, synthetic construct
  misc_feature 1..21: note = n-mer motif encoding polynucleotide
  source 1..21: mol_type = other DNA
aagggggatggtgcttatgag

SEQ ID NO: 559 - DNA, 21 bp, synthetic construct
  misc_feature 1..21: note = n-mer motif encoding polynucleotide
  source 1..21: mol_type = other DNA
cctatgaatggtattctgttg

SEQ ID NO: 560 - DNA, 21 bp, synthetic construct
  misc_feature 1..21: note = n-mer motif encoding polynucleotide
  source 1..21: mol_type = other DNA
agtagtgggggtatgaaggcg

SEQ ID NO: 561 - DNA, 21 bp, synthetic construct
  misc_feature 1..21: note = n-mer motif encoding polynucleotide
  source 1..21: mol_type = other DNA
gtgctggttactcagaatcat

SEQ ID NO: 562 - DNA, 21 bp, synthetic construct
  misc_feature 1..21: note = n-mer motif encoding polynucleotide
  source 1..21: mol_type = other DNA
gagattaataatcggactggt

SEQ ID NO: 563 - DNA, 21 bp, synthetic construct
  misc_feature 1..21: note = n-mer motif encoding polynucleotide
  source 1..21: mol_type = other DNA
ttaccaacaggcgtcctgccc

SEQ ID NO: 564 - DNA, 21 bp, synthetic construct
  misc_feature 1..21: note = n-mer motif encoding polynucleotide
  source 1..21: mol_type = other DNA
gcctacggtatcagagaagtg

SEQ ID NO: 565 - DNA, 21 bp, synthetic construct
  misc_feature 1..21: note = n-mer motif encoding polynucleotide
  source 1..21: mol_type = other DNA
tcgacaaactctataggcgcc

SEQ ID NO: 566 - DNA, 21 bp, synthetic construct
  misc_feature 1..21: note = n-mer motif encoding polynucleotide
  source 1..21: mol_type = other DNA
gtgcagttgacgcataatggg

SEQ ID NO: 567 - DNA, 21 bp, synthetic construct
  misc_feature 1..21: note = n-mer motif encoding polynucleotide
  source 1..21: mol_type = other DNA
gttcagttggagaatgcgaat

SEQ ID NO: 568 - DNA, 21 bp, synthetic construct
  misc_feature 1..21: note = n-mer motif encoding polynucleotide
  source 1..21: mol_type = other DNA
ggaaaagccaacgacggttct

SEQ ID NO: 569 - DNA, 21 bp, synthetic construct
  misc_feature 1..21: note = n-mer motif encoding polynucleotide
  source 1..21: mol_type = other DNA
accggggttcgagaaaccata

SEQ ID NO: 570 - DNA, 21 bp, synthetic construct
  misc_feature 1..21: note = n-mer motif encoding polynucleotide
  source 1..21: mol_type = other DNA
ggcctgaaccagatcacatcg

SEQ ID NO: 571 - DNA, 21 bp, synthetic construct
  misc_feature 1..21: note = n-mer motif encoding polynucleotide
  source 1..21: mol_type = other DNA
acggagaaggcgagtcctctg

SEQ ID NO: 572 - DNA, 21 bp, synthetic construct
  misc_feature 1..21: note = n-mer motif encoding polynucleotide
  source 1..21: mol_type = other DNA
tttctggagggtgttgcgcag

SEQ ID NO: 573 - DNA, 21 bp, synthetic construct
  misc_feature 1..21: note = n-mer motif encoding polynucleotide
  source 1..21: mol_type = other DNA
acgaattataatattggtccg

SEQ ID NO: 574 - DNA, 21 bp, synthetic construct
  misc_feature 1..21: note = n-mer motif encoding polynucleotide
  source 1..21: mol_type = other DNA
agaggagacttgacaaccaca

SEQ ID NO: 575 - DNA, 21 bp, synthetic construct
  misc_feature 1..21: note = n-mer motif encoding polynucleotide
  source 1..21: mol_type = other DNA
atgatgaatgtgagtggtcat

SEQ ID NO: 576 - DNA, 21 bp, synthetic construct
  misc_feature 1..21: note = n-mer motif encoding polynucleotide
  source 1..21: mol_type = other DNA
tctcagtcgattaatgggctt

SEQ ID NO: 577 - DNA, 21 bp, synthetic construct
  misc_feature 1..21: note = n-mer motif encoding polynucleotide
  source 1..21: mol_type = other DNA
ctcacgactttaactaaccac

SEQ ID NO: 578 - DNA, 21 bp, synthetic construct
  misc_feature 1..21: note = n-mer motif encoding polynucleotide
  source 1..21: mol_type = other DNA
aactctgttcaatccacccca

SEQ ID NO: 579 - DNA, 21 bp, synthetic construct
  misc_feature 1..21: note = n-mer motif encoding polynucleotide
  source 1..21: mol_type = other DNA
tataatacggatcggactaat

SEQ ID NO: 580 - DNA, 21 bp, synthetic construct
  misc_feature 1..21: note = n-mer motif encoding polynucleotide
  source 1..21: mol_type = other DNA
gagaagcctcagcataatagt

SEQ ID NO: 581 - DNA, 21 bp, synthetic construct
  misc_feature 1..21: note = n-mer motif encoding polynucleotide
  source 1..21: mol_type = other DNA
acgatggctacaaacttaagt

SEQ ID NO: 582 - DNA, 21 bp, synthetic construct
  misc_feature 1..21: note = n-mer motif encoding polynucleotide
  source 1..21: mol_type = other DNA
gtggggacgcatttgcattcg

SEQ ID NO: 583 - DNA, 21 bp, synthetic construct
  misc_feature 1..21: note = n-mer motif encoding polynucleotide
  source 1..21: mol_type = other DNA
gacgcccaccactcaagcagc

SEQ ID NO: 584 - DNA, 21 bp, synthetic construct
  misc_feature 1..21: note = n-mer motif encoding polynucleotide
  source 1..21: mol_type = other DNA
cttgtggggactttggtgtat

SEQ ID NO: 585 - DNA, 21 bp, synthetic construct
  misc_feature 1..21: note = n-mer motif encoding polynucleotide
  source 1..21: mol_type = other DNA
tatggtgtgcaggcgaatagt

SEQ ID NO: 586 - DNA, 21 bp, synthetic construct
  misc_feature 1..21: note = n-mer motif encoding polynucleotide
  source 1..21: mol_type = other DNA
gttttgtctgataaggcgtat

SEQ ID NO: 587 - DNA, 21 bp, synthetic construct
  misc_feature 1..21: note = n-mer motif encoding polynucleotide
  source 1..21: mol_type = other DNA
cttgagggtcagaataagacg

SEQ ID NO: 588 - DNA, 21 bp, synthetic construct
  misc_feature 1..21: note = n-mer motif encoding polynucleotide
  source 1..21: mol_type = other DNA
gaggttagtaataataattat

SEQ ID NO: 589 - DNA, 21 bp, synthetic construct
  misc_feature 1..21: note = n-mer motif encoding polynucleotide
  source 1..21: mol_type = other DNA
gcccaccaacaagccctagct

SEQ ID NO: 590 - DNA, 21 bp, synthetic construct
  misc_feature 1..21: note = n-mer motif encoding polynucleotide
  source 1..21: mol_type = other DNA
cttccgaccacactcaaccac

SEQ ID NO: 591 - DNA, 21 bp, synthetic construct
  misc_feature 1..21: note = n-mer motif encoding polynucleotide
  source 1..21: mol_type = other DNA
tacatagcaggtggtgaacaa

SEQ ID NO: 592 - DNA, 21 bp, synthetic construct
  misc_feature 1..21: note = n-mer motif encoding polynucleotide
  source 1..21: mol_type = other DNA
aattctggtactctttatcag

SEQ ID NO: 593 - DNA, 21 bp, synthetic construct
  misc_feature 1..21: note = n-mer motif encoding polynucleotide
  source 1..21: mol_type = other DNA
cggggtctgcctgatgttaat

SEQ ID NO: 594 - DNA, 21 bp, synthetic construct
  misc_feature 1..21: note = n-mer motif encoding polynucleotide
  source 1..21: mol_type = other DNA
aaccaacaactatcccactca

SEQ ID NO: 595 - DNA, 21 bp, synthetic construct
  misc_feature 1..21: note = n-mer motif encoding polynucleotide
  source 1..21: mol_type = other DNA
aatcctagttatgatcatcgg

SEQ ID NO: 596 - DNA, 21 bp, synthetic construct
  misc_feature 1..21: note = n-mer motif encoding polynucleotide
  source 1..21: mol_type = other DNA
atagacagcgacaccttcgta

SEQ ID NO: 597 - DNA, 21 bp, synthetic construct
  misc_feature 1..21: note = n-mer motif encoding polynucleotide
  source 1..21: mol_type = other DNA
accgcttaccttgcgggatta

SEQ ID NO: 598 - DNA, 21 bp, synthetic construct
  misc_feature 1..21: note = n-mer motif encoding polynucleotide
  source 1..21: mol_type = other DNA
catagtaatgttagtcttgag

SEQ ID NO: 599 - DNA, 21 bp, synthetic construct
  misc_feature 1..21: note = n-mer motif encoding polynucleotide
  source 1..21: mol_type = other DNA
ggtaataatttgagtttgtct

SEQ ID NO: 600 - DNA, 21 bp, synthetic construct
  misc_feature 1..21: note = n-mer motif encoding polynucleotide
  source 1..21: mol_type = other DNA
gttatggatacgcatgggatg

SEQ ID NO: 601 - DNA, 21 bp, synthetic construct
  misc_feature 1..21: note = n-mer motif encoding polynucleotide
  source 1..21: mol_type = other DNA
gcgtataatatgtcgtctgtt

SEQ ID NO: 602 - DNA, 21 bp, synthetic construct
  misc_feature 1..21: note = n-mer motif encoding polynucleotide
  source 1..21: mol_type = other DNA
actaacgccatctctcaaacg

SEQ ID NO: 603 - DNA, 21 bp, synthetic construct
  misc_feature 1..21: note = n-mer motif encoding polynucleotide
  source 1..21: mol_type = other DNA
gcaacacacgccatgcgccca

SEQ ID NO: 604 - DNA, 21 bp, synthetic construct
  misc_feature 1..21: note = n-mer motif encoding polynucleotide
  source 1..21: mol_type = other DNA
atgttaaacaacacaatgatg

SEQ ID NO: 605 - DNA, 21 bp, synthetic construct
  misc_feature 1..21: note = n-mer motif encoding polynucleotide
  source 1..21: mol_type = other DNA
attagttcggggattttgtcg

SEQ ID NO: 606 - DNA, 21 bp, synthetic construct
  misc_feature 1..21: note = n-mer motif encoding polynucleotide
  source 1..21: mol_type = other DNA
cgccaaggcagcttgatgata

SEQ ID NO: 607 - DNA, 21 bp, synthetic construct
  misc_feature 1..21: note = n-mer motif encoding polynucleotide
  source 1..21: mol_type = other DNA
acgactgataagggtattaat

SEQ ID NO: 608 - DNA, 21 bp, synthetic construct
  misc_feature 1..21: note = n-mer motif encoding polynucleotide
  source 1..21: mol_type = other DNA
cacaacttaatgacccaaata

SEQ ID NO: 609 - DNA, 21 bp, synthetic construct
  misc_feature 1..21: note = n-mer motif encoding polynucleotide
  source 1..21: mol_type = other DNA
aaccaaaacacctacgaactg

SEQ ID NO: 610 - DNA, 21 bp, synthetic construct
  misc_feature 1..21: note = n-mer motif encoding polynucleotide
  source 1..21: mol_type = other DNA
gctaacaccgtcacagaacga

SEQ ID NO: 611 - DNA, 21 bp, synthetic construct
  misc_feature 1..21: note = n-mer motif encoding polynucleotide
  source 1..21: mol_type = other DNA
tctacgctgcagactaatggt

SEQ ID NO: 612 - DNA, 21 bp, synthetic construct
  misc_feature 1..21: note = n-mer motif encoding polynucleotide
  source 1..21: mol_type = other DNA
cccaacgaatacaaagcaccg

SEQ ID NO: 613 - DNA, 21 bp, synthetic construct
  misc_feature 1..21: note = n-mer motif encoding polynucleotide
  source 1..21: mol_type = other DNA
atgcaaacacgctcggacaca

SEQ ID NO: 614 - DNA, 21 bp, synthetic construct
  misc_feature 1..21: note = n-mer motif encoding polynucleotide
  source 1..21: mol_type = other DNA
ggaacagggtacgctggatca

SEQ ID NO: 615 - DNA, 21 bp, synthetic construct
  misc_feature 1..21: note = n-mer motif encoding polynucleotide
  source 1..21: mol_type = other DNA
atgggtatgcagaatacgcat

SEQ ID NO: 616 - DNA, 21 bp, synthetic construct
  misc_feature 1..21: note = n-mer motif encoding polynucleotide
  source 1..21: mol_type = other DNA
tctagtaaggagcgtacatcg

SEQ ID NO: 617 - DNA, 21 bp, synthetic construct
  misc_feature 1..21: note = n-mer motif encoding polynucleotide
  source 1..21: mol_type = other DNA
cgaacggacaccccctacacc

SEQ ID NO: 618 - DNA, 21 bp, synthetic construct
  misc_feature 1..21: note = n-mer motif encoding polynucleotide
  source 1..21: mol_type = other DNA
actgcgctgcgggataataag

SEQ ID NO: 619 - DNA, 21 bp, synthetic construct
  misc_feature 1..21: note = n-mer motif encoding polynucleotide
  source 1..21: mol_type = other DNA
aggatgtctgagagttcggat

SEQ ID NO: 620 - DNA, 21 bp, synthetic construct
  misc_feature 1..21: note = n-mer motif encoding polynucleotide
  source 1..21: mol_type = other DNA
aaccaatctataagcatggac

SEQ ID NO: 621 - DNA, 21 bp, synthetic construct
  misc_feature 1..21: note = n-mer motif encoding polynucleotide
  source 1..21: mol_type = other DNA
tcgcttgggcatagtaataat

SEQ ID NO: 622 - DNA, 21 bp, synthetic construct
  misc_feature 1..21: note = n-mer motif encoding polynucleotide
  source 1..21: mol_type = other DNA
cttaatagtggtggtgcgatg

SEQ ID NO: 623 - DNA, 21 bp, synthetic construct
  misc_feature 1..21: note = n-mer motif encoding polynucleotide
  source 1..21: mol_type = other DNA
aacgaacaattcgaaaaagtc

SEQ ID NO: 624 - DNA, 21 bp, synthetic construct
  misc_feature 1..21: note = n-mer motif encoding polynucleotide
  source 1..21: mol_type = other DNA
atgatggcgaataatatgcag

SEQ ID NO: 625 - DNA, 21 bp, synthetic construct
  misc_feature 1..21: note = n-mer motif encoding polynucleotide
  source 1..21: mol_type = other DNA
agtcggcgcgaagaacaacca

SEQ ID NO: 626 - DNA, 21 bp, synthetic construct
  misc_feature 1..21: note = n-mer motif encoding polynucleotide
  source 1..21: mol_type = other DNA
gcgactatgacttcgtcgacg

SEQ ID NO: 627 - DNA, 21 bp, synthetic construct
  misc_feature 1..21: note = n-mer motif encoding polynucleotide
  source 1..21: mol_type = other DNA
cgtggttcagacggaggattg

SEQ ID NO: 628 - DNA, 21 bp, synthetic construct
  misc_feature 1..21: note = n-mer motif encoding polynucleotide
  source 1..21: mol_type = other DNA
agtttgacgcctaataatctt

SEQ ID NO: 629 - DNA, 21 bp, synthetic construct
  misc_feature 1..21: note = n-mer motif encoding polynucleotide
  source 1..21: mol_type = other DNA
gctactctttctccgcatgct

SEQ ID NO: 630 - DNA, 21 bp, synthetic construct
  misc_feature 1..21: note = n-mer motif encoding polynucleotide
  source 1..21: mol_type = other DNA
tatctgcaggagaagtttcct

SEQ ID NO: 631 - DNA, 21 bp, synthetic construct
  misc_feature 1..21: note = n-mer motif encoding polynucleotide
  source 1..21: mol_type = other DNA
ggcaccgggtacccaaaccaa

SEQ ID NO: 632 - DNA, 21 bp, synthetic construct
  misc_feature 1..21: note = n-mer motif encoding polynucleotide
  source 1..21: mol_type = other DNA
aattatccttcggttcaggag

SEQ ID NO: 633 - DNA, 21 bp, synthetic construct
  misc_feature 1..21: note = n-mer motif encoding polynucleotide
  source 1..21: mol_type = other DNA
actgacgcatcgggtagatca

SEQ ID NO: 634 - DNA, 21 bp, synthetic construct
  misc_feature 1..21: note = n-mer motif encoding polynucleotide
  source 1..21: mol_type = other DNA
cgtgtgattactgcgggtgat

SEQ ID NO: 635 - DNA, 21 bp, synthetic construct
  misc_feature 1..21: note = n-mer motif encoding polynucleotide
  source 1..21: mol_type = other DNA
gtgactgtgagtaatagtctg

SEQ ID NO: 636 - DNA, 21 bp, synthetic construct
  misc_feature 1..21: note = n-mer motif encoding polynucleotide
  source 1..21: mol_type = other DNA
ttgttgacggctccgcatagg

SEQ ID NO: 637 - DNA, 21 bp, synthetic construct
  misc_feature 1..21: note = n-mer motif encoding polynucleotide
  source 1..21: mol_type = other DNA
tcaatcgcaaaccacatgata

SEQ ID NO: 638 - DNA, 21 bp, synthetic construct
  misc_feature 1..21: note = n-mer motif encoding polynucleotide
  source 1..21: mol_type = other DNA
atgccttcgaaaggcgaagta

SEQ ID NO: 639 - DNA, 21 bp, synthetic construct
  misc_feature 1..21: note = n-mer motif encoding polynucleotide
  source 1..21: mol_type = other DNA
aacatgaccaacgaacggctc

SEQ ID NO: 640 - DNA, 21 bp, synthetic construct
  misc_feature 1..21: note = n-mer motif encoding polynucleotide
  source 1..21: mol_type = other DNA
tcattctcttcaggcataatg

SEQ ID NO: 641 - DNA, 21 bp, synthetic construct
  misc_feature 1..21: note = n-mer motif encoding polynucleotide
  source 1..21: mol_type = other DNA
cgcgaccgtcaagactcggta

SEQ ID NO: 642 - DNA, 21 bp, synthetic construct
  misc_feature 1..21: note = n-mer motif encoding polynucleotide
  source 1..21: mol_type = other DNA
cacggtgaccgaacagcttta

SEQ ID NO: 643 - DNA, 21 bp, synthetic construct
  misc_feature 1..21: note = n-mer motif encoding polynucleotide
  source 1..21: mol_type = other DNA
gaagtacggggcagcgtgcca

SEQ ID NO: 644 - DNA, 21 bp, synthetic construct
  misc_feature 1..21: note = n-mer motif encoding polynucleotide
  source 1..21: mol_type = other DNA
ctgatttcgactggtaataat

SEQ ID NO: 645 - DNA, 21 bp, synthetic construct
  misc_feature 1..21: note = n-mer motif encoding polynucleotide
  source 1..21: mol_type = other DNA
ccaacatctggggacaaaccg

SEQ ID NO: 646 - DNA, 21 bp, synthetic construct
  misc_feature 1..21: note = n-mer motif encoding polynucleotide
  source 1..21: mol_type = other DNA
aaagcggaccacagtggggca

SEQ ID NO: 647 - DNA, 21 bp, synthetic construct
  misc_feature 1..21: note = n-mer motif encoding polynucleotide
  source 1..21: mol_type = other DNA
ctaaacgacgtctaccgtaaa

SEQ ID NO: 648 - DNA, 21 bp, synthetic construct
  misc_feature 1..21: note = n-mer motif encoding polynucleotide
  source 1..21: mol_type = other DNA
aacagtttgcaagcaagtgca

SEQ ID NO: 649 - DNA, 21 bp, synthetic construct
  misc_feature 1..21: note = n-mer motif encoding polynucleotide
  source 1..21: mol_type = other DNA
tatcataatgagattatgacg

SEQ ID NO: 650 - DNA, 21 bp, synthetic construct
  misc_feature 1..21: note = n-mer motif encoding polynucleotide
  source 1..21: mol_type = other DNA
aacaacaccctaaacatccta

SEQ ID NO: 651 - DNA, 21 bp, synthetic construct
  misc_feature 1..21: note = n-mer motif encoding polynucleotide
  source 1..21: mol_type = other DNA
tcttatgggcagggtctggag

SEQ ID NO: 652 - DNA, 21 bp, synthetic construct
  misc_feature 1..21: note = n-mer motif encoding polynucleotide
  source 1..21: mol_type = other DNA
atgataaaaaccaacatgttg

SEQ ID NO: 653 - DNA, 21 bp, synthetic construct
  misc_feature 1..21: note = n-mer motif encoding polynucleotide
  source 1..21: mol_type = other DNA
accgaagcgggccgcccccaa

SEQ ID NO: 654 - DNA, 21 bp, synthetic construct
  misc_feature 1..21: note = n-mer motif encoding polynucleotide
  source 1..21: mol_type = other DNA
aggattgatcagactaatgtg

SEQ ID NO: 655 - DNA, 21 bp, synthetic construct
  misc_feature 1..21: note = n-mer motif encoding polynucleotide
  source 1..21: mol_type = other DNA
gaggggcataatcgtggtatt

SEQ ID NO: 656 - DNA, 21 bp, synthetic construct
  misc_feature 1..21: note = n-mer motif encoding polynucleotide
  source 1..21: mol_type = other DNA
atggggactgagtatcgtatg

SEQ ID NO: 657 - DNA, 21 bp, synthetic construct
  misc_feature 1..21: note = n-mer motif encoding polynucleotide
  source 1..21: mol_type = other DNA
tcgggtatgaatagtaataag

SEQ ID NO: 658 - DNA, 21 bp, synthetic construct
  misc_feature 1..21: note = n-mer motif encoding polynucleotide
  source 1..21: mol_type = other DNA
ttgactaatgataataagttg

SEQ ID NO: 659 - DNA, 21 bp, synthetic construct
  misc_feature 1..21: note = n-mer motif encoding polynucleotide
  source 1..21: mol_type = other DNA
ttacacaactaccaagaccgt

SEQ ID NO: 660 - DNA, 21 bp, synthetic construct
  misc_feature 1..21: note = n-mer motif encoding polynucleotide
  source 1..21: mol_type = other DNA
aagtctaatttggagggtaag

SEQ ID NO: 661 - DNA, 21 bp, synthetic construct
  misc_feature 1..21: note = n-mer motif encoding polynucleotide
  source 1..21: mol_type = other DNA
cttactggtcagaatgcgatt

SEQ ID NO: 662 - DNA, 21 bp, synthetic construct
  misc_feature 1..21: note = n-mer motif encoding polynucleotide
  source 1..21: mol_type = other DNA
catactgtgggggctatgcat

SEQ ID NO: 663 - DNA, 21 bp, synthetic construct
  misc_feature 1..21: note = n-mer motif encoding polynucleotide
  source 1..21: mol_type = other DNA
ctccaactggctacatcccac

SEQ ID NO: 664 - DNA, 21 bp, synthetic construct
  misc_feature 1..21: note = n-mer motif encoding polynucleotide
  source 1..21: mol_type = other DNA
agtctgaatggggtgttggtt

SEQ ID NO: 665 - DNA, 21 bp, synthetic construct
  misc_feature 1..21: note = n-mer motif encoding polynucleotide
  source 1..21: mol_type = other DNA
agtcacaaccaagtaaacgta

SEQ ID NO: 666 - DNA, 21 bp, synthetic construct
  misc_feature 1..21: note = n-mer motif encoding polynucleotide
  source 1..21: mol_type = other DNA
agtttgagtactgatgtgttt

SEQ ID NO: 667 - DNA, 21 bp, synthetic construct
  misc_feature 1..21: note = n-mer motif encoding polynucleotide
  source 1..21: mol_type = other DNA
atggtaggtcgtgccgaaatc

SEQ ID NO: 668 - DNA, 21 bp, synthetic construct
  misc_feature 1..21: note = n-mer motif encoding polynucleotide
  source 1..21: mol_type = other DNA
ttgtctagtatgagtacggat

SEQ ID NO: 669 - DNA, 21 bp, synthetic construct
  misc_feature 1..21: note = n-mer motif encoding polynucleotide
  source 1..21: mol_type = other DNA
tcctacagtacttcaacaccg

SEQ ID NO: 670 - DNA, 21 bp, synthetic construct
  misc_feature 1..21: note = n-mer motif encoding polynucleotide
  source 1..21: mol_type = other DNA
tccgaattaatggtcagaccc

SEQ ID NO: 671 - DNA, 21 bp, synthetic construct
  misc_feature 1..21: note = n-mer motif encoding polynucleotide
  source 1..21: mol_type = other DNA
tggaacggaaacgccacacaa

SEQ ID NO: 672 - DNA, 21 bp, synthetic construct
  misc_feature 1..21: note = n-mer motif encoding polynucleotide
  source 1..21: mol_type = other DNA
atggatactgagctttatagg

SEQ ID NO: 673 - DNA, 21 bp, synthetic construct
  misc_feature 1..21: note = n-mer motif encoding polynucleotide
  source 1..21: mol_type = other DNA
aggacgagtcctgatacgaat

SEQ ID NO: 674 - DNA, 21 bp, synthetic construct
  misc_feature 1..21: note = n-mer motif encoding polynucleotide
  source 1..21: mol_type = other DNA
ttctcaacgcaagacataagc

SEQ ID NO: 675 - DNA, 21 bp, synthetic construct
  misc_feature 1..21: note = n-mer motif encoding polynucleotide
  source 1..21: mol_type = other DNA
acgactgtgctggggaataat

SEQ ID NO: 676 - DNA, 21 bp, synthetic construct
  misc_feature 1..21: note = n-mer motif encoding polynucleotide
  source 1..21: mol_type = other DNA
cagcgtgatgctgcgtatgct

SEQ ID NO: 677 - DNA, 21 bp, synthetic construct
  misc_feature 1..21: note = n-mer motif encoding polynucleotide
  source 1..21: mol_type = other DNA
caccaaaccgtggtccctact

SEQ ID NO: 678 - DNA, 21 bp, synthetic construct
  misc_feature 1..21: note = n-mer motif encoding polynucleotide
  source 1..21: mol_type = other DNA
tctaatccgggtaatcataat

SEQ ID NO: 679 - DNA, 21 bp, synthetic construct
  misc_feature 1..21: note = n-mer motif encoding polynucleotide
  source 1..21: mol_type = other DNA
tgggagactatggctaagcct

SEQ ID NO: 680 - DNA, 21 bp, synthetic construct
  misc_feature 1..21: note = n-mer motif encoding polynucleotide
  source 1..21: mol_type = other DNA
ggtctttatcagaatcctacg

SEQ ID NO: 681 - DNA, 21 bp, synthetic construct
  misc_feature 1..21: note = n-mer motif encoding polynucleotide
  source 1..21: mol_type = other DNA
cttaatcttactaatcataat

SEQ ID NO: 682 - DNA, 21 bp, synthetic construct
  misc_feature 1..21: note = n-mer motif encoding polynucleotide
  source 1..21: mol_type = other DNA
atgagtctcgcctccacccaa

SEQ ID NO: 683 - DNA, 21 bp, synthetic construct
  misc_feature 1..21: note = n-mer motif encoding polynucleotide
  source 1..21: mol_type = other DNA
acgtcccaaaccgtccgagta

SEQ ID NO: 684 - DNA, 21 bp, synthetic construct
  misc_feature 1..21: note = n-mer motif encoding polynucleotide
  source 1..21: mol_type = other DNA
ggagcaacggtcaacacgcga

SEQ ID NO: 685 - DNA, 21 bp, synthetic construct
  misc_feature 1..21: note = n-mer motif encoding polynucleotide
  source 1..21: mol_type = other DNA
aaagggggaaacctcaccgca

SEQ ID NO: 686 - DNA, 21 bp, synthetic construct
  misc_feature 1..21: note = n-mer motif encoding polynucleotide
  source 1..21: mol_type = other DNA
gcgtggtctcaagtcctgacg

SEQ ID NO: 687 - DNA, 21 bp, synthetic construct
  misc_feature 1..21: note = n-mer motif encoding polynucleotide
  source 1..21: mol_type = other DNA
gtagaacacgtagcccaccaa

SEQ ID NO: 688 - DNA, 21 bp, synthetic construct
  misc_feature 1..21: note = n-mer motif encoding polynucleotide
  source 1..21: mol_type = other DNA
ctaatgtcgtcctactcatca

SEQ ID NO: 689 - DNA, 21 bp, synthetic construct
  misc_feature 1..21: note = n-mer motif encoding polynucleotide
  source 1..21: mol_type = other DNA
tctctgggtgggaatccgcct

SEQ ID NO: 690 - DNA, 21 bp, synthetic construct
  misc_feature 1..21: note = n-mer motif encoding polynucleotide
  source 1..21: mol_type = other DNA
aagaatgagaatacgaattat

SEQ ID NO: 691 - DNA, 21 bp, synthetic construct
  misc_feature 1..21: note = n-mer motif encoding polynucleotide
  source 1..21: mol_type = other DNA
atattggacaaccaccgtttc

SEQ ID NO: 692 - DNA, 21 bp, synthetic construct
  misc_feature 1..21: note = n-mer motif encoding polynucleotide
  source 1..21: mol_type = other DNA
aattcgtcgcatgttaattct

SEQ ID NO: 693 - DNA, 21 bp, synthetic construct
  misc_feature 1..21: note = n-mer motif encoding polynucleotide
  source 1..21: mol_type = other DNA
caggtgcagcatgagagggtg

SEQ ID NO: 694 - DNA, 21 bp, synthetic construct
  misc_feature 1..21: note = n-mer motif encoding polynucleotide
  source 1..21: mol_type = other DNA
ttgggaggaaccctgggaata

SEQ ID NO: 695 - DNA, 21 bp, synthetic construct
  misc_feature 1..21: note = n-mer motif encoding polynucleotide
  source 1..21: mol_type = other DNA
actcaagaacgaccactaatc

SEQ ID NO: 696 - DNA, 21 bp, synthetic construct
  misc_feature 1..21: note = n-mer motif encoding polynucleotide
  source 1..21: mol_type = other DNA
cgtaagactgaggataggatg

SEQ ID NO: 697 - DNA, 21 bp, synthetic construct
  misc_feature 1..21: note = n-mer motif encoding polynucleotide
  source 1..21: mol_type = other DNA
accgaactcacagcgcggaac

SEQ ID NO: 698 - DNA, 21 bp, synthetic construct
  misc_feature 1..21: note = n-mer motif encoding polynucleotide
  source 1..21: mol_type = other DNA
cgcggcgacaacacttactcc

SEQ ID NO: 699 - DNA, 21 bp, synthetic construct
  misc_feature 1..21: note = n-mer motif encoding polynucleotide
  source 1..21: mol_type = other DNA
cagtctaatactaataatagt

SEQ ID NO: 700 - DNA, 21 bp, synthetic construct
  misc_feature 1..21: note = n-mer motif encoding polynucleotide
  source 1..21: mol_type = other DNA
gcttcttatagtatttctgat

SEQ ID NO: 701 - DNA, 21 bp, synthetic construct
  misc_feature 1..21: note = n-mer motif encoding polynucleotide
  source 1..21: mol_type = other DNA
agcgaacaccacgccggaata

SEQ ID NO: 702 - DNA, 21 bp, synthetic construct
  misc_feature 1..21: note = n-mer motif encoding polynucleotide
  source 1..21: mol_type = other DNA
cgtggtgcgccagagcatgcg

SEQ ID NO: 703 - DNA, 21 bp, synthetic construct
  misc_feature 1..21: note = n-mer motif encoding polynucleotide
  source 1..21: mol_type = other DNA
aattttagtagtggtgatgtt

SEQ ID NO: 704 - DNA, 21 bp, synthetic construct
  misc_feature 1..21: note = n-mer motif encoding polynucleotide
  source 1..21: mol_type = other DNA
agtggcatcaacgccaccgac

SEQ ID NO: 705 - DNA, 21 bp, synthetic construct
  misc_feature 1..21: note = n-mer motif encoding polynucleotide
  source 1..21: mol_type = other DNA
cgggctgatgtttcttggtct

SEQ ID NO: 706 - DNA, 21 bp, synthetic construct
  misc_feature 1..21: note = n-mer motif encoding polynucleotide
  source 1..21: mol_type = other DNA
tgtatggatgttggtaaggcg

SEQ ID NO: 707 - DNA, 21 bp, synthetic construct
  misc_feature 1..21: note = n-mer motif encoding polynucleotide
  source 1..21: mol_type = other DNA
ggggtcggagccacttcggta

SEQ ID NO: 708 - DNA, 21 bp, synthetic construct
  misc_feature 1..21: note = n-mer motif encoding polynucleotide
  source 1..21: mol_type = other DNA
aaaaacaacaactcagacagt

SEQ ID NO: 709 - DNA, 21 bp, synthetic construct
  misc_feature 1..21: note = n-mer motif encoding polynucleotide
  source 1..21: mol_type = other DNA
aatgttgcgagtattgatagg

SEQ ID NO: 710 - DNA, 21 bp, synthetic construct
  misc_feature 1..21: note = n-mer motif encoding polynucleotide
  source 1..21: mol_type = other DNA
aatagtgtgaatggtcttctg

SEQ ID NO: 711 - DNA, 21 bp, synthetic construct
  misc_feature 1..21: note = n-mer motif encoding polynucleotide
  source 1..21: mol_type = other DNA
acactagaccgaaaccaaacc

SEQ ID NO: 712 - DNA, 21 bp, synthetic construct
  misc_feature 1..21: note = n-mer motif encoding polynucleotide
  source 1..21: mol_type = other DNA
gaccaaaacttcgaacgtaga

SEQ ID NO: 713 - DNA, 21 bp, synthetic construct
  misc_feature 1..21: note = n-mer motif encoding polynucleotide
  source 1..21: mol_type = other DNA
gtcggtgacaggaacttggtc

SEQ ID NO: 714 - DNA, 21 bp, synthetic construct
  misc_feature 1..21: note = n-mer motif encoding polynucleotide
  source 1..21: mol_type = other DNA
ttagaagtaaacctgcaaacg

SEQ ID NO: 715 - DNA, 21 bp, synthetic construct
  misc_feature 1..21: note = n-mer motif encoding polynucleotide
  source 1..21: mol_type = other DNA
actaatggggggtcgcttaat

SEQ ID NO: 716 - DNA, 21 bp, synthetic construct
  misc_feature 1..21: note = n-mer motif encoding polynucleotide
  source 1..21: mol_type = other DNA
ttcacgcgcacaccagtaacc

SEQ ID NO: 717 - DNA, 21 bp, synthetic construct
  misc_feature 1..21: note = n-mer motif encoding polynucleotide
  source 1..21: mol_type = other DNA
acaccggcggaaagcaaagtt

SEQ ID NO: 718 - DNA, 21 bp, synthetic construct
  misc_feature 1..21: note = n-mer motif encoding polynucleotide
  source 1..21: mol_type = other DNA
tttccttcgcataatggggcg

SEQ ID NO: 719 - DNA, 21 bp, synthetic construct
  misc_feature 1..21: note = n-mer motif encoding polynucleotide
  source 1..21: mol_type = other DNA
gccaggaacgtaatgctgggg

SEQ ID NO: 720 - DNA, 21 bp, synthetic construct
  misc_feature 1..21: note = n-mer motif encoding polynucleotide
  source 1..21: mol_type = other DNA
acgattcaggatcatattaag

SEQ ID NO: 721 - DNA, 21 bp, synthetic construct
  misc_feature 1..21: note = n-mer motif encoding polynucleotide
  source 1..21: mol_type = other DNA
attaattcgtatttgcatgag

SEQ ID NO: 722 - DNA, 21 bp, synthetic construct
  misc_feature 1..21: note = n-mer motif encoding polynucleotide
  source 1..21: mol_type = other DNA
gcgcatgatgttactgtgaat

SEQ ID NO: 723 - DNA, 21 bp, synthetic construct
  misc_feature 1..21: note = n-mer motif encoding polynucleotide
  source 1..21: mol_type = other DNA
actgtgggggttcagcagacg

SEQ ID NO: 724 - DNA, 21 bp, synthetic construct
  misc_feature 1..21: note = n-mer motif encoding polynucleotide
  source 1..21: mol_type = other DNA
acaggtagttcagacagatta

SEQ ID NO: 725 - DNA, 21 bp, synthetic construct
  misc_feature 1..21: note = n-mer motif encoding polynucleotide
  source 1..21: mol_type = other DNA
aatcatgatactgctcatgct

SEQ ID NO: 726 - DNA, 21 bp, synthetic construct
  misc_feature 1..21: note = n-mer motif encoding polynucleotide
  source 1..21: mol_type = other DNA
gccgaatcccaactagctagc

SEQ ID NO: 727 - DNA, 21 bp, synthetic construct
  misc_feature 1..21: note = n-mer motif encoding polynucleotide
  source 1..21: mol_type = other DNA
ggtaatgcgtataatacgact

SEQ ID NO: 728 - DNA, 21 bp, synthetic construct
  misc_feature 1..21: note = n-mer motif encoding polynucleotide
  source 1..21: mol_type = other DNA
aatcatcaggctggtactact

SEQ ID NO: 729 - DNA, 21 bp, synthetic construct
  misc_feature 1..21: note = n-mer motif encoding polynucleotide
  source 1..21: mol_type = other DNA
acggtaggagaaaaccaccga

SEQ ID NO: 730 - DNA, 21 bp, synthetic construct
  misc_feature 1..21: note = n-mer motif encoding polynucleotide
  source 1..21: mol_type = other DNA
ctaactactaaaatacccctc

SEQ ID NO: 731 - DNA, 21 bp, synthetic construct
  misc_feature 1..21: note = n-mer motif encoding polynucleotide
  source 1..21: mol_type = other DNA
actaattatcctgaggcgaat

SEQ ID NO: 732 - DNA, 21 bp, synthetic construct
  misc_feature 1..21: note = n-mer motif encoding polynucleotide
  source 1..21: mol_type = other DNA
aatactgctccgccgaatcat

SEQ ID NO: 733 - DNA, 21 bp, synthetic construct
  misc_feature 1..21: note = n-mer motif encoding polynucleotide
  source 1..21: mol_type = other DNA
gtgctgagtacggggctgcgg

SEQ ID NO: 734 - DNA, 21 bp, synthetic construct
  misc_feature 1..21: note = n-mer motif encoding polynucleotide
  source 1..21: mol_type = other DNA
ctcacgtcccactctgcgggc

SEQ ID NO: 735 - DNA, 21 bp, synthetic construct
  misc_feature 1..21: note = n-mer motif encoding polynucleotide
  source 1..21: mol_type = other DNA
atgaataagcatggtgtgctt

SEQ ID NO: 736 - DNA, 21 bp, synthetic construct
  misc_feature 1..21: note = n-mer motif encoding polynucleotide
  source 1..21: mol_type = other DNA
gacctgaccagagctgcaata

SEQ ID NO: 737 - DNA, 21 bp, synthetic construct
  misc_feature 1..21: note = n-mer motif encoding polynucleotide
  source 1..21: mol_type = other DNA
tatattgtggatcatgcgaat

SEQ ID NO: 738 - DNA, 21 bp, synthetic construct
  misc_feature 1..21: note = n-mer motif encoding polynucleotide
  source 1..21: mol_type = other DNA
agtgggcctgagaatacgttg

SEQ ID NO: 739 - DNA, 21 bp, synthetic construct
  misc_feature 1..21: note = n-mer motif encoding polynucleotide
  source 1..21: mol_type = other DNA
cgttatggtgatacgggtatg

SEQ ID NO: 740 - DNA, 21 bp, synthetic construct
  misc_feature 1..21: note = n-mer motif encoding polynucleotide
  source 1..21: mol_type = other DNA
gatggtaagaatagttatgcg

SEQ ID NO: 741 - DNA, 21 bp, synthetic construct
  misc_feature 1..21: note = n-mer motif encoding polynucleotide
  source 1..21: mol_type = other DNA
gaggcgcataatcgtgttatt

SEQ ID NO: 742 - DNA, 21 bp, synthetic construct
  misc_feature 1..21: note = n-mer motif encoding polynucleotide
  source 1..21: mol_type = other DNA
agtttgcaggctggtaggatg

SEQ ID NO: 743 - DNA, 21 bp, synthetic construct
  misc_feature 1..21: note = n-mer motif encoding polynucleotide
  source 1..21: mol_type = other DNA
gatgcgaaggctcttacgact

SEQ ID NO: 744 - DNA, 21 bp, synthetic construct
  misc_feature 1..21: note = n-mer motif encoding polynucleotide
  source 1..21: mol_type = other DNA
accgacacccgaaaaaacgac

SEQ ID NO: 745 - DNA, 21 bp, synthetic construct
  misc_feature 1..21: note = n-mer motif encoding polynucleotide
  source 1..21: mol_type = other DNA
gactcttcacactactcgaca

SEQ ID NO: 746 - DNA, 21 bp, synthetic construct
  misc_feature 1..21: note = n-mer motif encoding polynucleotide
  source 1..21: mol_type = other DNA
acaatgcaccttcccaacctg

SEQ ID NO: 747 - DNA, 21 bp, synthetic construct
  misc_feature 1..21: note = n-mer motif encoding polynucleotide
  source 1..21: mol_type = other DNA
cgagacggctctactaaagtt

SEQ ID NO: 748 - DNA, 21 bp, synthetic construct
  misc_feature 1..21: note = n-mer motif encoding polynucleotide
  source 1..21: mol_type = other DNA
tcagggtaccaaatgacagaa

SEQ ID NO: 749 - DNA, 21 bp, synthetic construct
  misc_feature 1..21: note = n-mer motif encoding polynucleotide
  source 1..21: mol_type = other DNA
tgcgacttgtcacaatcatgc

SEQ ID NO: 750 - DNA, 21 bp, synthetic construct
  misc_feature 1..21: note = n-mer motif encoding polynucleotide
  source 1..21: mol_type = other DNA
agaaacgcgtcaaacggcgta

SEQ ID NO: 751 - DNA, 21 bp, synthetic construct
  misc_feature 1..21: note = n-mer motif encoding polynucleotide
  source 1..21: mol_type = other DNA
cagtcgcagaatgtgactcag

SEQ ID NO: 752 - DNA, 21 bp, synthetic construct
  misc_feature 1..21: note = n-mer motif encoding polynucleotide
  source 1..21: mol_type = other DNA
gattctgctccgagtactatt

SEQ ID NO: 753 - DNA, 21 bp, synthetic construct
  misc_feature 1..21: note = n-mer motif encoding polynucleotide
  source 1..21: mol_type = other DNA
aggtccgtaccatcaccacac

SEQ ID NO: 754 - DNA, 21 bp, synthetic construct
  misc_feature 1..21: note = n-mer motif encoding polynucleotide
  source 1..21: mol_type = other DNA
atgacgtctgcgtctcgtggt

SEQ ID NO: 755 - DNA, 21 bp, synthetic construct
  misc_feature 1..21: note = n-mer motif encoding polynucleotide
  source 1..21: mol_type = other DNA
gctcttgctagtcgtcctatg

SEQ ID NO: 756 - DNA, 21 bp, synthetic construct
  misc_feature 1..21: note = n-mer motif encoding polynucleotide
  source 1..21: mol_type = other DNA
ctaaacctctccaacgactgg

SEQ ID NO: 757 - DNA, 21 bp, synthetic construct
  misc_feature 1..21: note = n-mer motif encoding polynucleotide
  source 1..21: mol_type = other DNA
gtttctacggcgcagaggcag

SEQ ID NO: 758 - DNA, 21 bp, synthetic construct
  misc_feature 1..21: note = n-mer motif encoding polynucleotide
  source 1..21: mol_type = other DNA
cacgccgacgttggcatgagc

SEQ ID NO: 759 - DNA, 21 bp, synthetic construct
  misc_feature 1..21: note = n-mer motif encoding polynucleotide
  source 1..21: mol_type = other DNA
gcggggggtttgctgtcgcgg

SEQ ID NO: 760 - DNA, 21 bp, synthetic construct
  misc_feature 1..21: note = n-mer motif encoding polynucleotide
  source 1..21: mol_type = other DNA
catcttagtcaggctaatcat

SEQ ID NO: 761 - DNA, 21 bp, synthetic construct
  misc_feature 1..21: note = n-mer motif encoding polynucleotide
  source 1..21: mol_type = other DNA
gtgcataatcctactactacg

SEQ ID NO: 762 - DNA, 21 bp, synthetic construct
  misc_feature 1..21: note = n-mer motif encoding polynucleotide
  source 1..21: mol_type = other DNA
tctcagcggaatccggatgat

SEQ ID NO: 763 - DNA, 21 bp, synthetic construct
  misc_feature 1..21: note = n-mer motif encoding polynucleotide
  source 1..21: mol_type = other DNA
agggagactaataattttgcg

SEQ ID NO: 764 - DNA, 21 bp, synthetic construct
  misc_feature 1..21: note = n-mer motif encoding polynucleotide
  source 1..21: mol_type = other DNA
aatgcgggggctcttatgggt

SEQ ID NO: 765 - DNA, 21 bp, synthetic construct
  misc_feature 1..21: note = n-mer motif encoding polynucleotide
  source 1..21: mol_type = other DNA
ttgccgaagactgtgaatatg

SEQ ID NO: 766 - DNA, 21 bp, synthetic construct
  misc_feature 1..21: note = n-mer motif encoding polynucleotide
  source 1..21: mol_type = other DNA
gcaagtgacctacaaatgacg

SEQ ID NO: 767 - DNA, 21 bp, synthetic construct
  misc_feature 1..21: note = n-mer motif encoding polynucleotide
  source 1..21: mol_type = other DNA
caagccctggccaccacaaac

SEQ ID NO: 768 - DNA, 21 bp, synthetic construct
  misc_feature 1..21: note = n-mer motif encoding polynucleotide
  source 1..21: mol_type = other DNA
catgagtcgtctggttatcat

SEQ ID NO: 769 - DNA, 21 bp, synthetic construct
  misc_feature 1..21: note = n-mer motif encoding polynucleotide
  source 1..21: mol_type = other DNA
ggggtgaatgatcgtgctagg

SEQ ID NO: 770 - DNA, 21 bp, synthetic construct
  misc_feature 1..21: note = n-mer motif encoding polynucleotide
  source 1..21: mol_type = other DNA
cctcgggatgctcttcgtact

SEQ ID NO: 771 - DNA, 21 bp, synthetic construct
  misc_feature 1..21: note = n-mer motif encoding polynucleotide
  source 1..21: mol_type = other DNA
aacgactcctcgtcaatgtcc

SEQ ID NO: 772 - DNA, 21 bp, synthetic construct
  misc_feature 1..21: note = n-mer motif encoding polynucleotide
  source 1..21: mol_type = other DNA
gaatacaacacgcgccacgac

SEQ ID NO: 773 - DNA, 21 bp, synthetic construct
  misc_feature 1..21: note = n-mer motif encoding polynucleotide
  source 1..21: mol_type = other DNA
gcgtctccggcgcatacgtct

SEQ ID NO: 774 - DNA, 21 bp, synthetic construct
  misc_feature 1..21: note = n-mer motif encoding polynucleotide
  source 1..21: mol_type = other DNA
caaaacagcaacactccctca

SEQ ID NO: 775 - DNA, 21 bp, synthetic construct
  misc_feature 1..21: note = n-mer motif encoding polynucleotide
  source 1..21: mol_type = other DNA
ttggcaaaactagggaactac

SEQ ID NO: 776 - DNA, 21 bp, synthetic construct
  misc_feature 1..21: note = n-mer motif encoding polynucleotide
  source 1..21: mol_type = other DNA
gctagtgataggcagtctggt

SEQ ID NO: 777 - DNA, 21 bp, synthetic construct
  misc_feature 1..21: note = n-mer motif encoding polynucleotide
  source 1..21: mol_type = other DNA
tatcagaatggtgtgcttcct

SEQ ID NO: 778 - DNA, 21 bp, synthetic construct
  misc_feature 1..21: note = n-mer motif encoding polynucleotide
  source 1..21: mol_type = other DNA
aataagtttggttataatcct

SEQ ID NO: 779 - DNA, 21 bp, synthetic construct
  misc_feature 1..21: note = n-mer motif encoding polynucleotide
  source 1..21: mol_type = other DNA
aaaaaaaccaacggaatcccc

SEQ ID NO: 780 - DNA, 21 bp, synthetic construct
  misc_feature 1..21: note = n-mer motif encoding polynucleotide
  source 1..21: mol_type = other DNA
gttaacgacaaccgaggaaac

SEQ ID NO: 781 - DNA, 21 bp, synthetic construct
  misc_feature 1..21: note = n-mer motif encoding polynucleotide
  source 1..21: mol_type = other DNA
atgcacaccataacgggatcc

SEQ ID NO: 782 - DNA, 21 bp, synthetic construct
  misc_feature 1..21: note = n-mer motif encoding polynucleotide
  source 1..21: mol_type = other DNA
attgatggtgttcagaagctt

SEQ ID NO: 783 - DNA, 21 bp, synthetic construct
  misc_feature 1..21: note = n-mer motif encoding polynucleotide
  source 1..21: mol_type = other DNA
gcgcaggttaataatcatgat

SEQ ID NO: 784 - DNA, 21 bp, synthetic construct
  misc_feature 1..21: note = n-mer motif encoding polynucleotide
  source 1..21: mol_type = other DNA
gtttcttcgcctaatggtacg

SEQ ID NO: 785 - DNA, 21 bp, synthetic construct
  misc_feature 1..21: note = n-mer motif encoding polynucleotide
  source 1..21: mol_type = other DNA
gattctgctccgagggctatt

SEQ ID NO: 786 - DNA, 21 bp, synthetic construct
  misc_feature 1..21: note = n-mer motif encoding polynucleotide
  source 1..21: mol_type = other DNA
tctgcgagtgatagtcagcat

SEQ ID NO: 787 - DNA, 21 bp, synthetic construct
  misc_feature 1..21: note = n-mer motif encoding polynucleotide
  source 1..21: mol_type = other DNA
tcggctcatcagacgccgacg

SEQ ID NO: 788 - DNA, 21 bp, synthetic construct
  misc_feature 1..21: note = n-mer motif encoding polynucleotide
  source 1..21: mol_type = other DNA
gcgacgctgaataatagttat

SEQ ID NO: 789 - DNA, 21 bp, synthetic construct
  misc_feature 1..21: note = n-mer motif encoding polynucleotide
  source 1..21: mol_type = other DNA
gaagacagtatgagattctct

SEQ ID NO: 790 - DNA, 21 bp, synthetic construct
  misc_feature 1..21: note = n-mer motif encoding polynucleotide
  source 1..21: mol_type = other DNA
gaacgaaacggactaatagaa

SEQ ID NO: 791 - DNA, 21 bp, synthetic construct
  misc_feature 1..21: note = n-mer motif encoding polynucleotide
  source 1..21: mol_type = other DNA
ttagtacttgactcacggaac

SEQ ID NO: 792 - DNA, 21 bp, synthetic construct
  misc_feature 1..21: note = n-mer motif encoding polynucleotide
  source 1..21: mol_type = other DNA
accgtcgaacaaataaactcg

SEQ ID NO: 793 - DNA, 21 bp, synthetic construct
  misc_feature 1..21: note = n-mer motif encoding polynucleotide
  source 1..21: mol_type = other DNA
gggacaggtaccgttggatgg

SEQ ID NO: 794 - DNA, 21 bp, synthetic construct
  misc_feature 1..21: note = n-mer motif encoding polynucleotide
  source 1..21: mol_type = other DNA
aatcagcagcgtattgataat

SEQ ID NO: 795 - DNA, 21 bp, synthetic construct
  misc_feature 1..21: note = n-mer motif encoding polynucleotide
  source 1..21: mol_type = other DNA
atccaaaacggggtcctgcca

SEQ ID NO: 796 - DNA, 21 bp, synthetic construct
  misc_feature 1..21: note = n-mer motif encoding polynucleotide
  source 1..21: mol_type = other DNA
ggagacatctcaagcagaaac

SEQ ID NO: 797 - DNA, 21 bp, synthetic construct
  misc_feature 1..21: note = n-mer motif encoding polynucleotide
  source 1..21: mol_type = other DNA
gtcactggcactaccccggga

SEQ ID NO: 798 - DNA, 21 bp, synthetic construct
  misc_feature 1..21: note = n-mer motif encoding polynucleotide
  source 1..21: mol_type = other DNA
acaagggaatcaatgtccatc

SEQ ID NO: 799 - DNA, 21 bp, synthetic construct
  misc_feature 1..21: note = n-mer motif encoding polynucleotide
  source 1..21: mol_type = other DNA
cacacttactcacaagcagac

SEQ ID NO: 800 - DNA, 21 bp, synthetic construct
  misc_feature 1..21: note = n-mer motif encoding polynucleotide
  source 1..21: mol_type = other DNA
tccaacatgggcgtagcctct

SEQ ID NO: 801 - DNA, 21 bp, synthetic construct
  misc_feature 1..21: note = n-mer motif encoding polynucleotide
  source 1..21: mol_type = other DNA
cacgacttgaaccacggaaaa

SEQ ID NO: 802 - DNA, 21 bp, synthetic construct
  misc_feature 1..21: note = n-mer motif encoding polynucleotide
  source 1..21: mol_type = other DNA
ctgtacgggggagcacaccaa

SEQ ID NO: 803 - DNA, 21 bp, synthetic construct
  misc_feature 1..21: note = n-mer motif encoding polynucleotide
  source 1..21: mol_type = other DNA
aacgtgtacggagacggaata

SEQ ID NO: 804 - DNA, 21 bp, synthetic construct
  misc_feature 1..21: note = n-mer motif encoding polynucleotide
  source 1..21: mol_type = other DNA
tctactattaatatgcgtgcg

SEQ ID NO: 805 - DNA, 21 bp, synthetic construct
  misc_feature 1..21: note = n-mer motif encoding polynucleotide
  source 1..21: mol_type = other DNA
aagatggggagtattgaggtt

SEQ ID NO: 806 - DNA, 21 bp, synthetic construct
  misc_feature 1..21: note = n-mer motif encoding polynucleotide
  source 1..21: mol_type = other DNA
tccgaaacgcgcgctggatac

SEQ ID NO: 807 - DNA, 21 bp, synthetic construct
  misc_feature 1..21: note = n-mer motif encoding polynucleotide
  source 1..21: mol_type = other DNA
aatgtgggtaatactcttggg

SEQ ID NO: 808 - DNA, 21 bp, synthetic construct
  misc_feature 1..21: note = n-mer motif encoding polynucleotide
  source 1..21: mol_type = other DNA
attggtgggactgatacgcgg

SEQ ID NO: 809 - DNA, 21 bp, synthetic construct
  misc_feature 1..21: note = n-mer motif encoding polynucleotide
  source 1..21: mol_type = other DNA
gccgacaaaggattcggccac

SEQ ID NO: 810 - DNA, 21 bp, synthetic construct
  misc_feature 1..21: note = n-mer motif encoding polynucleotide
  source 1..21: mol_type = other DNA
tggcaggatcataataaggtg

SEQ ID NO: 811 - DNA, 21 bp, synthetic construct
  misc_feature 1..21: note = n-mer motif encoding polynucleotide
  source 1..21: mol_type = other DNA
aactacggttccggacgaatc

SEQ ID NO: 812 - DNA, 21 bp, synthetic construct
  misc_feature 1..21: note = n-mer motif encoding polynucleotide
  source 1..21: mol_type = other DNA
actcataagcaggtggatctt

SEQ ID NO: 813 - DNA, 21 bp, synthetic construct
  misc_feature 1..21: note = n-mer motif encoding polynucleotide
  source 1..21: mol_type = other DNA
cggcagaatgataagggtaat

SEQ ID NO: 814 - DNA, 21 bp, synthetic construct
  misc_feature 1..21: note = n-mer motif encoding polynucleotide
  source 1..21: mol_type = other DNA
ggtaggaatgagagtccggag

SEQ ID NO: 815 - DNA, 21 bp, synthetic construct
  misc_feature 1..21: note = n-mer motif encoding polynucleotide
  source 1..21: mol_type = other DNA
gtttttactgggcagacggag

SEQ ID NO: 816 - DNA, 21 bp, synthetic construct
  misc_feature 1..21: note = n-mer motif encoding polynucleotide
  source 1..21: mol_type = other DNA
tatgttgatcgtaaggataat

SEQ ID NO: 817 - DNA, 21 bp, synthetic construct
  misc_feature 1..21: note = n-mer motif encoding polynucleotide
  source 1..21: mol_type = other DNA
aataatactttgaatattttg

SEQ ID NO: 818 - DNA, 21 bp, synthetic construct
  misc_feature 1..21: note = n-mer motif encoding polynucleotide
  source 1..21: mol_type = other DNA
ttgagctacagcatccaacac

SEQ ID NO: 819 - DNA, 21 bp, synthetic construct
  misc_feature 1..21: note = n-mer motif encoding polynucleotide
  source 1..21: mol_type = other DNA
gctaccaacagatcgccccta

SEQ ID NO: 820 - DNA, 21 bp, synthetic construct
  misc_feature 1..21: note = n-mer motif encoding polynucleotide
  source 1..21: mol_type = other DNA
gttcacaccgcagacacaata

SEQ ID NO: 821 - DNA, 21 bp, synthetic construct
  misc_feature 1..21: note = n-mer motif encoding polynucleotide
  source 1..21: mol_type = other DNA
gggcatttggttaatatgtct

SEQ ID NO: 822 - DNA, 21 bp, synthetic construct
  misc_feature 1..21: note = n-mer motif encoding polynucleotide
  source 1..21: mol_type = other DNA
ttagactacacccctcaaaac

SEQ ID NO: 823 - DNA, 21 bp, synthetic construct
  misc_feature 1..21: note = n-mer motif encoding polynucleotide
  source 1..21: mol_type = other DNA
tccgcctcttactccaggatg

SEQ ID NO: 824 - DNA, 21 bp, synthetic construct
  misc_feature 1..21: note = n-mer motif encoding polynucleotide
  source 1..21: mol_type = other DNA
tccggagcggcacaaaaccca

SEQ ID NO: 825 - DNA, 21 bp, synthetic construct
  misc_feature 1..21: note = n-mer motif encoding polynucleotide
  source 1..21: mol_type = other DNA
agaaacacacttgctgacctt

SEQ ID NO: 826 - DNA, 21 bp, synthetic construct
  misc_feature 1..21: note = n-mer motif encoding polynucleotide
  source 1..21: mol_type = other DNA
ggttctacggtgtcggcgcag

SEQ ID NO: 827 - DNA, 21 bp, synthetic construct
  misc_feature 1..21: note = n-mer motif encoding polynucleotide
  source 1..21: mol_type = other DNA
tctaaggatagtactatgtat

SEQ ID NO: 828 - DNA, 21 bp, synthetic construct
  misc_feature 1..21: note = n-mer motif encoding polynucleotide
  source 1..21: mol_type = other DNA
gtggtggttcacactatccca

SEQ ID NO: 829 - DNA, 21 bp, synthetic construct
  misc_feature 1..21: note = n-mer motif encoding polynucleotide
  source 1..21: mol_type = other DNA
ccacgtactgtctcattggac

SEQ ID NO: 830 - DNA, 21 bp, synthetic construct
  misc_feature 1..21: note = n-mer motif encoding polynucleotide
  source 1..21: mol_type = other DNA
atgatgaagagtgaggagaat

SEQ ID NO: 831 - DNA, 21 bp, synthetic construct
  misc_feature 1..21: note = n-mer motif encoding polynucleotide
  source 1..21: mol_type = other DNA
accaccgaccggccaaacgga

SEQ ID NO: 832 - DNA, 21 bp, synthetic construct
  misc_feature 1..21: note = n-mer motif encoding polynucleotide
  source 1..21: mol_type = other DNA
catagtcctcctacgactatg

SEQ ID NO: 833 - DNA, 21 bp, synthetic construct
  misc_feature 1..21: note = n-mer motif encoding polynucleotide
  source 1..21: mol_type = other DNA
ggccaatggacaacagggaca

SEQ ID NO: 834 - DNA, 21 bp, synthetic construct
  misc_feature 1..21: note = n-mer motif encoding polynucleotide
  source 1..21: mol_type = other DNA
gacggtatgaacggagtgggt

SEQ ID NO: 835 - DNA, 21 bp, synthetic construct
  misc_feature 1..21: note = n-mer motif encoding polynucleotide
  source 1..21: mol_type = other DNA
cttcatactgttgcgaatgag

SEQ ID NO: 836 - DNA, 21 bp, synthetic construct
  misc_feature 1..21: note = n-mer motif encoding polynucleotide
  source 1..21: mol_type = other DNA
tatacgtcgcagacgtctacg

SEQ ID NO: 837 - DNA, 21 bp, synthetic construct
  misc_feature 1..21: note = n-mer motif encoding polynucleotide
  source 1..21: mol_type = other DNA
aacttctccgaaatgtccaca

SEQ ID NO: 838 - DNA, 21 bp, synthetic construct
  misc_feature 1..21: note = n-mer motif encoding polynucleotide
  source 1..21: mol_type = other DNA
attaatattcgtagtgatttg

SEQ ID NO: 839 - DNA, 21 bp, synthetic construct
  misc_feature 1..21: note = n-mer motif encoding polynucleotide
  source 1..21: mol_type = other DNA
ccctccaacagtgaaagattc

SEQ ID NO: 840 - DNA, 21 bp, synthetic construct
  misc_feature 1..21: note = n-mer motif encoding polynucleotide
  source 1..21: mol_type = other DNA
tatacgaattatggggatctt

SEQ ID NO: 841 - DNA, 21 bp, synthetic construct
  misc_feature 1..21: note = n-mer motif encoding polynucleotide
  source 1..21: mol_type = other DNA
gataagagtacggcgcaggcg

SEQ ID NO: 842 - DNA, 21 bp, synthetic construct
  misc_feature 1..21: note = n-mer motif encoding polynucleotide
  source 1..21: mol_type = other DNA
cacaccgacatggtatcctct

SEQ ID NO: 843 - DNA, 21 bp, synthetic construct
  misc_feature 1..21: note = n-mer motif encoding polynucleotide
  source 1..21: mol_type = other DNA
aacaaaagtctgtcaatggac

SEQ ID NO: 844 - DNA, 21 bp, synthetic construct
  misc_feature 1..21: note = n-mer motif encoding polynucleotide
  source 1..21: mol_type = other DNA
gggcactacgctacaaacaca

SEQ ID NO: 845 - DNA, 21 bp, synthetic construct
  misc_feature 1..21: note = n-mer motif encoding polynucleotide
  source 1..21: mol_type = other DNA
gtcatcgtatctacaaaatca

SEQ ID NO: 846 - DNA, 21 bp, synthetic construct
  misc_feature 1..21: note = n-mer motif encoding polynucleotide
  source 1..21: mol_type = other DNA
actcatagtcttatgaatgat

SEQ ID NO: 847 - DNA, 21 bp, synthetic construct
  misc_feature 1..21: note = n-mer motif encoding polynucleotide
  source 1..21: mol_type = other DNA
aactaccacggagacaacgtt

SEQ ID NO: 848 - DNA, 21 bp, synthetic construct
  misc_feature 1..21: note = n-mer motif encoding polynucleotide
  source 1..21: mol_type = other DNA
cgtgatgatcagcagcttgat

SEQ ID NO: 849 - DNA, 21 bp, synthetic construct
  misc_feature 1..21: note = n-mer motif encoding polynucleotide
  source 1..21: mol_type = other DNA
gatgataagactggtcggtat

SEQ ID NO: 850 - DNA, 21 bp, synthetic construct
  misc_feature 1..21: note = n-mer motif encoding polynucleotide
  source 1..21: mol_type = other DNA
gggtcgagccaacaccacgaa

SEQ ID NO: 851 - DNA, 21 bp, synthetic construct
  misc_feature 1..21: note = n-mer motif encoding polynucleotide
  source 1..21: mol_type = other DNA
cgtgttacaggtgtctcaaca

SEQ ID NO: 852 - DNA, 21 bp, synthetic construct
  misc_feature 1..21: note = n-mer motif encoding polynucleotide
  source 1..21: mol_type = other DNA
agtactgcgtcggggcatact

SEQ ID NO: 853 - DNA, 21 bp, synthetic construct
  misc_feature 1..21: note = n-mer motif encoding polynucleotide
  source 1..21: mol_type = other DNA
actaacaacctctcatacgaa

SEQ ID NO: 854 - DNA, 21 bp, synthetic construct
  misc_feature 1..21: note = n-mer motif encoding polynucleotide
  source 1..21: mol_type = other DNA
cagcataatagtgcgtcggcg

SEQ ID NO: 855 - DNA, 21 bp, synthetic construct
  misc_feature 1..21: note = n-mer motif encoding polynucleotide
  source 1..21: mol_type = other DNA
ccggctaagggttttggtcat

SEQ ID NO: 856 - DNA, 21 bp, synthetic construct
  misc_feature 1..21: note = n-mer motif encoding polynucleotide
  source 1..21: mol_type = other DNA
tggtacgaaacaatcagcccg

SEQ ID NO: 857 - DNA, 21 bp, synthetic construct
  misc_feature 1..21: note = n-mer motif encoding polynucleotide
  source 1..21: mol_type = other DNA
acggatgctacggggaggcat

SEQ ID NO: 858 - DNA, 21 bp, synthetic construct
  misc_feature 1..21: note = n-mer motif encoding polynucleotide
  source 1..21: mol_type = other DNA
attcaggcgaagaattctgag

SEQ ID NO: 859 - DNA, 21 bp, synthetic construct
  misc_feature 1..21: note = n-mer motif encoding polynucleotide
  source 1..21: mol_type = other DNA
agtactgagactaggggtggg

SEQ ID NO: 860 - DNA, 21 bp, synthetic construct
  misc_feature 1..21: note = n-mer motif encoding polynucleotide
  source 1..21: mol_type = other DNA
ttctcaacaaactctgtaatc

SEQ ID NO: 861 - DNA, 21 bp, synthetic construct
  misc_feature 1..21: note = n-mer motif encoding polynucleotide
  source 1..21: mol_type = other DNA
tctaaccttcgaaacacaata

SEQ ID NO: 862 - DNA, 21 bp, synthetic construct
  misc_feature 1..21: note = n-mer motif encoding polynucleotide
  source 1..21: mol_type = other DNA
gggatgatcgggcacaacgca

SEQ ID NO: 863 - DNA, 21 bp, synthetic construct
  misc_feature 1..21: note = n-mer motif encoding polynucleotide
  source 1..21: mol_type = other DNA
tctggccaaggattctcggca

SEQ ID NO: 864 - DNA, 21 bp, synthetic construct
  misc_feature 1..21: note = n-mer motif encoding polynucleotide
  source 1..21: mol_type = other DNA
acccacaactctacaggcctt

SEQ ID NO: 865 - DNA, 21 bp, synthetic construct
  misc_feature 1..21: note = n-mer motif encoding polynucleotide
  source 1..21: mol_type = other DNA
aggattgatagtgctatggtg

SEQ ID NO: 866 - DNA, 21 bp, synthetic construct
  misc_feature 1..21: note = n-mer motif encoding polynucleotide
  source 1..21: mol_type = other DNA
gtcgctatgggaggcggtccc

SEQ ID NO: 867 - DNA, 21 bp, synthetic construct
  misc_feature 1..21: note = n-mer motif encoding polynucleotide
  source 1..21: mol_type = other DNA
ggctctcacaacggcccagcc

SEQ ID NO: 868 - DNA, 21 bp, synthetic construct
  misc_feature 1..21: note = n-mer motif encoding polynucleotide
  source 1..21: mol_type = other DNA
cactccgcagcgggtgacggt

SEQ ID NO: 869 - DNA, 21 bp, synthetic construct
  misc_feature 1..21: note = n-mer motif encoding polynucleotide
  source 1..21: mol_type = other DNA
gcacaaggcataacccacgct

SEQ ID NO: 870 - DNA, 21 bp, synthetic construct
  misc_feature 1..21: note = n-mer motif encoding polynucleotide
  source 1..21: mol_type = other DNA
tctgcgcttttgcggatggat

SEQ ID NO: 871 - DNA, 21 bp, synthetic construct
  misc_feature 1..21: note = n-mer motif encoding polynucleotide
  source 1..21: mol_type = other DNA
tggcaaatgggggccgggagc

SEQ ID NO: 872 - DNA, 21 bp, synthetic construct
  misc_feature 1..21: note = n-mer motif encoding polynucleotide
  source 1..21: mol_type = other DNA
atagactcgcacgccagcata

SEQ ID NO: 873 - DNA, 21 bp, synthetic construct
  misc_feature 1..21: note = n-mer motif encoding polynucleotide
  source 1..21: mol_type = other DNA
agcctagaccacgcccctcta

SEQ ID NO: 874 - DNA, 21 bp, synthetic construct
  misc_feature 1..21: note = n-mer motif encoding polynucleotide
  source 1..21: mol_type = other DNA
gaaaacaacatgcaacacggc

SEQ ID NO: 875 - DNA, 21 bp, synthetic construct
  misc_feature 1..21: note = n-mer motif encoding polynucleotide
  source 1..21: mol_type = other DNA
aagggtgcgcagggtgttcag

SEQ ID NO: 876 - DNA, 21 bp, synthetic construct
  misc_feature 1..21: note = n-mer motif encoding polynucleotide
  source 1..21: mol_type = other DNA
gtcgctgtatcgaacactcca

SEQ ID NO: 877 - DNA, 21 bp, synthetic construct
  misc_feature 1..21: note = n-mer motif encoding polynucleotide
  source 1..21: mol_type = other DNA
gttgagtcttcttattctcgg

SEQ ID NO: 878 - DNA, 21 bp, synthetic construct
  misc_feature 1..21: note = n-mer motif encoding polynucleotide
  source 1..21: mol_type = other DNA
cataatacggagtctaagact

SEQ ID NO: 879 - DNA, 21 bp, synthetic construct
  misc_feature 1..21: note = n-mer motif encoding polynucleotide
  source 1..21: mol_type = other DNA
aatgagagtacgaaggagagt

SEQ ID NO: 880 - DNA, 21 bp, synthetic construct
  misc_feature 1..21: note = n-mer motif encoding polynucleotide
  source 1..21: mol_type = other DNA
gatgtttatcttaagagtccg

SEQ ID NO: 881 - DNA, 21 bp, synthetic construct
  misc_feature 1..21: note = n-mer motif encoding polynucleotide
  source 1..21: mol_type = other DNA
cagtcgggggctaggactctg

SEQ ID NO: 882 - DNA, 21 bp, synthetic construct
  misc_feature 1..21: note = n-mer motif encoding polynucleotide
  source 1..21: mol_type = other DNA
tcgaacagtcaagtacacaac

SEQ ID NO: 883 - DNA, 21 bp, synthetic construct
  misc_feature 1..21: note = n-mer motif encoding polynucleotide
  source 1..21: mol_type = other DNA
gtagtctcatcgggcggctgg

SEQ ID NO: 884 - DNA, 21 bp, synthetic construct
  misc_feature 1..21: note = n-mer motif encoding polynucleotide
  source 1..21: mol_type = other DNA
ccatcaagtttcaacagcgcc

SEQ ID NO: 885 - DNA, 21 bp, synthetic construct
  misc_feature 1..21: note = n-mer motif encoding polynucleotide
  source 1..21: mol_type = other DNA
aagcagactgatagtaggggt

SEQ ID NO: 886 - DNA, 21 bp, synthetic construct
  misc_feature 1..21: note = n-mer motif encoding polynucleotide
  source 1..21: mol_type = other DNA
aacacaacgccacctaaccac

SEQ ID NO: 887 - DNA, 21 bp, synthetic construct
  misc_feature 1..21: note = n-mer motif encoding polynucleotide
  source 1..21: mol_type = other DNA
caaaacggaacctcgtctata

SEQ ID NO: 888 - DNA, 21 bp, synthetic construct
  misc_feature 1..21: note = n-mer motif encoding polynucleotide
  source 1..21: mol_type = other DNA
ctcatgaaagacatggaatcc

SEQ ID NO: 889 - DNA, 21 bp, synthetic construct
  misc_feature 1..21: note = n-mer motif encoding polynucleotide
  source 1..21: mol_type = other DNA
actcagactggtcatgtttct

SEQ ID NO: 890 - DNA, 21 bp, synthetic construct
  misc_feature 1..21: note = n-mer motif encoding polynucleotide
  source 1..21: mol_type = other DNA
gaaatacacacgaccacaggc

SEQ ID NO: 891 - DNA, 21 bp, synthetic construct
  misc_feature 1..21: note = n-mer motif encoding polynucleotide
  source 1..21: mol_type = other DNA
atacaaactactacaaaatgc

SEQ ID NO: 892 - DNA, 21 bp, synthetic construct
  misc_feature 1..21: note = n-mer motif encoding polynucleotide
  source 1..21: mol_type = other DNA
cccgctgaaggaaacaaccgt

SEQ ID NO: 893 - DNA, 21 bp, synthetic construct
  misc_feature 1..21: note = n-mer motif encoding polynucleotide
  source 1..21: mol_type = other DNA
tacatcgccggaggggaacaa

SEQ ID NO: 894 - DNA, 21 bp, synthetic construct
  misc_feature 1..21: note = n-mer motif encoding polynucleotide
  source 1..21: mol_type = other DNA
gaagtacgcgaccaaaaaaca

SEQ ID NO: 895 - DNA, 21 bp, synthetic construct
  misc_feature 1..21: note = n-mer motif encoding polynucleotide
  source 1..21: mol_type = other DNA
tacgccgtcgcgataggcaca

SEQ ID NO: 896 - DNA, 21 bp, synthetic construct
  misc_feature 1..21: note = n-mer motif encoding polynucleotide
  source 1..21: mol_type = other DNA
tccgctaacgaacacaaccac

SEQ ID NO: 897 - DNA, 21 bp, synthetic construct
  misc_feature 1..21: note = n-mer motif encoding polynucleotide
  source 1..21: mol_type = other DNA
gggatgagggatacgccgccg

SEQ ID NO: 898 - DNA, 21 bp, synthetic construct
  misc_feature 1..21: note = n-mer motif encoding polynucleotide
  source 1..21: mol_type = other DNA
gctcagcagattgttaatggg

SEQ ID NO: 899 - DNA, 21 bp, synthetic construct
  misc_feature 1..21: note = n-mer motif encoding polynucleotide
  source 1..21: mol_type = other DNA
tcaagttcccaaacggttttg

SEQ ID NO: 900 - DNA, 21 bp, synthetic construct
  misc_feature 1..21: note = n-mer motif encoding polynucleotide
  source 1..21: mol_type = other DNA
gttattcagtctgataatacg

SEQ ID NO: 901 - DNA, 21 bp, synthetic construct
  misc_feature 1..21: note = n-mer motif encoding polynucleotide
  source 1..21: mol_type = other DNA
gttccggcgcattctcggggt

SEQ ID NO: 902 - DNA, 21 bp, synthetic construct
  misc_feature 1..21: note = n-mer motif encoding polynucleotide
  source 1..21: mol_type = other DNA
tcgaatacggggtcgttgggt

SEQ ID NO: 903 - DNA, 21 bp, synthetic construct
  misc_feature 1..21: note = n-mer motif encoding polynucleotide
  source 1..21: mol_type = other DNA
tgggccaaagacgtcaacgtc

SEQ ID NO: 904 - DNA, 21 bp, synthetic construct
  misc_feature 1..21: note = n-mer motif encoding polynucleotide
  source 1..21: mol_type = other DNA
aatgtgttgggtgcttcgagt

SEQ ID NO: 905 - DNA, 21 bp, synthetic construct
  misc_feature 1..21: note = n-mer motif encoding polynucleotide
  source 1..21: mol_type = other DNA
actccggaggctagtgcgcgt

SEQ ID NO: 906 - DNA, 21 bp, synthetic construct
  misc_feature 1..21: note = n-mer motif encoding polynucleotide
  source 1..21: mol_type = other DNA
aattataatggggttaatgtg

SEQ ID NO: 907 - DNA, 21 bp, synthetic construct
  misc_feature 1..21: note = n-mer motif encoding polynucleotide
  source 1..21: mol_type = other DNA
aacacaaccggtagctcgggc

SEQ ID NO: 908 - DNA, 21 bp, synthetic construct
  misc_feature 1..21: note = n-mer motif encoding polynucleotide
  source 1..21: mol_type = other DNA
tccagcggccaaccgctcgtc

SEQ ID NO: 909 - DNA, 21 bp, synthetic construct
  misc_feature 1..21: note = n-mer motif encoding polynucleotide
  source 1..21: mol_type = other DNA
caggcggggggtgtggcgagt

SEQ ID NO: 910 - DNA, 21 bp, synthetic construct
  misc_feature 1..21: note = n-mer motif encoding polynucleotide
  source 1..21: mol_type = other DNA
ccgcttcaatcccaatcggga

SEQ ID NO: 911 - DNA, 21 bp, synthetic construct
  misc_feature 1..21: note = n-mer motif encoding polynucleotide
  source 1..21: mol_type = other DNA
caacgtacctcggaagcgcca

SEQ ID NO: 912 - DNA, 21 bp, synthetic construct
  misc_feature 1..21: note = n-mer motif encoding polynucleotide
  source 1..21: mol_type = other DNA
ttggctaagacggttgcgatt

SEQ ID NO: 913 - DNA, 21 bp, synthetic construct
  misc_feature 1..21: note = n-mer motif encoding polynucleotide
  source 1..21: mol_type = other DNA
acccacacccttgggggaaca

SEQ ID NO: 914 - DNA, 21 bp, synthetic construct
  misc_feature 1..21: note = n-mer motif encoding polynucleotide
  source 1..21: mol_type = other DNA
cacgactacagtatgaacgcg

SEQ ID NO: 915 - DNA, 21 bp, synthetic construct
  misc_feature 1..21: note = n-mer motif encoding polynucleotide
  source 1..21: mol_type = other DNA
gggaaacctgcggaagcgccg

SEQ ID NO: 916 - DNA, 21 bp, synthetic construct
  misc_feature 1..21: note = n-mer motif encoding polynucleotide
  source 1..21: mol_type = other DNA
agaaacgaaaacgtaaacgct

SEQ ID NO: 917 - DNA, 21 bp, synthetic construct
  misc_feature 1..21: note = n-mer motif encoding polynucleotide
  source 1..21: mol_type = other DNA
agttctcgggaggcgaagttt

SEQ ID NO: 918 - DNA, 21 bp, synthetic construct
  misc_feature 1..21: note = n-mer motif encoding polynucleotide
  source 1..21: mol_type = other DNA
tcttcttctgatagtccgcgt

SEQ ID NO: 919 - DNA, 21 bp, synthetic construct
  misc_feature 1..21: note = n-mer motif encoding polynucleotide
  source 1..21: mol_type = other DNA
atgaatacgacttataatgag

SEQ ID NO: 920 - DNA, 21 bp, synthetic construct
  misc_feature 1..21: note = n-mer motif encoding polynucleotide
  source 1..21: mol_type = other DNA
gtaaggagtggaataaaacca

SEQ ID NO: 921 - DNA, 21 bp, synthetic construct
  misc_feature 1..21: note = n-mer motif encoding polynucleotide
  source 1..21: mol_type = other DNA
caggagaatcctatgaagatg

SEQ ID NO: 922 - DNA, 21 bp, synthetic construct
  misc_feature 1..21: note = n-mer motif encoding polynucleotide
  source 1..21: mol_type = other DNA
actgagccgcttccgatgtct

SEQ ID NO: 923 - DNA, 21 bp, synthetic construct
  misc_feature 1..21: note = n-mer motif encoding polynucleotide
  source 1..21: mol_type = other DNA
cgccacggggacacaccgatg

SEQ ID NO: 924 - DNA, 21 bp, synthetic construct
  misc_feature 1..21: note = n-mer motif encoding polynucleotide
  source 1..21: mol_type = other DNA
gcggtgaatacgtataatagt

SEQ ID NO: 925 - DNA, 21 bp, synthetic construct
  misc_feature 1..21: note = n-mer motif encoding polynucleotide
  source 1..21: mol_type = other DNA
gcgtcgactgagtctcatgtg

SEQ ID NO: 926 - DNA, 21 bp, synthetic construct
  misc_feature 1..21: note = n-mer motif encoding polynucleotide
  source 1..21: mol_type = other DNA
acaaacctaagtcaatcggcc

SEQ ID NO: 927 - DNA, 21 bp, synthetic construct
  misc_feature 1..21: note = n-mer motif encoding polynucleotide
  source 1..21: mol_type = other DNA
gagctgtctactcctatggtt

SEQ ID NO: 928 - DNA, 21 bp, synthetic construct
  misc_feature 1..21: note = n-mer motif encoding polynucleotide
  source 1..21: mol_type = other DNA
tatgcgcatcctgtgactcat

SEQ ID NO: 929 - DNA, 21 bp, synthetic construct
  misc_feature 1..21: note = n-mer motif encoding polynucleotide
  source 1..21: mol_type = other DNA
cgggggtctactggtacgcag

SEQ ID NO: 930 - DNA, 21 bp, synthetic construct
  misc_feature 1..21: note = n-mer motif encoding polynucleotide
  source 1..21: mol_type = other DNA
tgtgttggttcgtgtggtgtg

SEQ ID NO: 931 - DNA, 21 bp, synthetic construct
  misc_feature 1..21: note = n-mer motif encoding polynucleotide
  source 1..21: mol_type = other DNA
tcggttgctaaggatcagacg

SEQ ID NO: 932 - DNA, 21 bp, synthetic construct
  misc_feature 1..21: note = n-mer motif encoding polynucleotide
  source 1..21: mol_type = other DNA
acgaatctttctcctaagacg

SEQ ID NO: 933 - DNA, 21 bp, synthetic construct
  misc_feature 1..21: note = n-mer motif encoding polynucleotide
  source 1..21: mol_type = other DNA
ctaggtttcacaccccaaccg

SEQ ID NO: 934 - DNA, 21 bp, synthetic construct
  misc_feature 1..21: note = n-mer motif encoding polynucleotide
  source 1..21: mol_type = other DNA
aatattagtagtattaatcag

SEQ ID NO: 935 - DNA, 21 bp, synthetic construct
  misc_feature 1..21: note = n-mer motif encoding polynucleotide
  source 1..21: mol_type = other DNA
gtttacgacaacgtttcttct

SEQ ID NO: 936 - DNA, 21 bp, synthetic construct
  misc_feature 1..21: note = n-mer motif encoding polynucleotide
  source 1..21: mol_type = other DNA
agtggaaaacaagacaaatac

SEQ ID NO: 937 - DNA, 21 bp, synthetic construct
  misc_feature 1..21: note = n-mer motif encoding polynucleotide
  source 1..21: mol_type = other DNA
agacttacagaactggtcata

SEQ ID NO: 938 - DNA, 21 bp, synthetic construct
  misc_feature 1..21: note = n-mer motif encoding polynucleotide
  source 1..21: mol_type = other DNA
cataagagtgagagtcataat

SEQ ID NO: 939 - DNA, 21 bp, synthetic construct
  misc_feature 1..21: note = n-mer motif encoding polynucleotide
  source 1..21: mol_type = other DNA
gaggcgactcatggttcttat

SEQ ID NO: 940 - DNA, 21 bp, synthetic construct
  misc_feature 1..21: note = n-mer motif encoding polynucleotide
  source 1..21: mol_type = other DNA
aacctacttgtcgaccaacgt

SEQ ID NO: 941 - DNA, 21 bp, synthetic construct
  misc_feature 1..21: note = n-mer motif encoding polynucleotide
  source 1..21: mol_type = other DNA
aatattaatgatactaagaat

SEQ ID NO: 942 - DNA, 21 bp, synthetic construct
  misc_feature 1..21: note = n-mer motif encoding polynucleotide
  source 1..21: mol_type = other DNA
cttgcggttacgaatgtgcgg

SEQ ID NO: 943 - DNA, 21 bp, synthetic construct
  misc_feature 1..21: note = n-mer motif encoding polynucleotide
  source 1..21: mol_type = other DNA
ccgtcgacactcgctgaaaca

SEQ ID NO: 944 - DNA, 21 bp, synthetic construct
  misc_feature 1..21: note = n-mer motif encoding polynucleotide
  source 1..21: mol_type = other DNA
ccgaagcctgggacgggggag

SEQ ID NO: 945 - DNA, 21 bp, synthetic construct
  misc_feature 1..21: note = n-mer motif encoding polynucleotide
  source 1..21: mol_type = other DNA
gtgctgttgcagaattctcat

SEQ ID NO: 946 - DNA, 21 bp, synthetic construct
  misc_feature 1..21: note = n-mer motif encoding polynucleotide
  source 1..21: mol_type = other DNA
tacggtaacgcgaacaccgta

SEQ ID NO: 947 - DNA, 21 bp, synthetic construct
  misc_feature 1..21: note = n-mer motif encoding polynucleotide
  source 1..21: mol_type = other DNA
acatctggagttctgacacgc

SEQ ID NO: 948 - DNA, 21 bp, synthetic construct
  misc_feature 1..21: note = n-mer motif encoding polynucleotide
  source 1..21: mol_type = other DNA
aaaataacggaaaccaacctc

SEQ ID NO: 949 - DNA, 21 bp, synthetic construct
  misc_feature 1..21: note = n-mer motif encoding polynucleotide
  source 1..21: mol_type = other DNA
gttcgcagagacgaaacacct

SEQ ID NO: 950 - DNA, 21 bp, synthetic construct
  misc_feature 1..21: note = n-mer motif encoding polynucleotide
  source 1..21: mol_type = other DNA
tctaaaatgtcaaacccagtg

SEQ ID NO: 951 - DNA, 21 bp, synthetic construct
  misc_feature 1..21: note = n-mer motif encoding polynucleotide
  source 1..21: mol_type = other DNA
tgggaatccctctccaacgca

SEQ ID NO: 952 - DNA, 21 bp, synthetic construct
  misc_feature 1..21: note = n-mer motif encoding polynucleotide
  source 1..21: mol_type = other DNA
gccaacggaggaggatacccc

SEQ ID NO: 953 - DNA, 21 bp, synthetic construct
  misc_feature 1..21: note = n-mer motif encoding polynucleotide
  source 1..21: mol_type = other DNA
atgttggcttctcgggtgcct

SEQ ID NO: 954 - DNA, 21 bp, synthetic construct
  misc_feature 1..21: note = n-mer motif encoding polynucleotide
  source 1..21: mol_type = other DNA
tgcggcctgaactgcggtaaa

SEQ ID NO: 955 - DNA, 21 bp, synthetic construct
  misc_feature 1..21: note = n-mer motif encoding polynucleotide
  source 1..21: mol_type = other DNA
actattactagtccgtcggtg

SEQ ID NO: 956 - DNA, 21 bp, synthetic construct
  misc_feature 1..21: note = n-mer motif encoding polynucleotide
  source 1..21: mol_type = other DNA
tggtcgaatgctcagagtccg

SEQ ID NO: 957 - DNA, 21 bp, synthetic construct
  misc_feature 1..21: note = n-mer motif encoding polynucleotide
  source 1..21: mol_type = other DNA
acagaaagccccaaactacta

SEQ ID NO: 958 - DNA, 21 bp, synthetic construct
  misc_feature 1..21: note = n-mer motif encoding polynucleotide
  source 1..21: mol_type = other DNA
catttggttactagtggtatt

SEQ ID NO: 959 - DNA, 21 bp, synthetic construct
  misc_feature 1..21: note = n-mer motif encoding polynucleotide
  source 1..21: mol_type = other DNA
cctcctaagtcggattcgaat

SEQ ID NO: 960 - DNA, 21 bp, synthetic construct
  misc_feature 1..21: note = n-mer motif encoding polynucleotide
  source 1..21: mol_type = other DNA
attgcggtgcatgtgctgagt

SEQ ID NO: 961 - DNA, 21 bp, synthetic construct
  misc_feature 1..21: note = n-mer motif encoding polynucleotide
  source 1..21: mol_type = other DNA
actggtactgcgactttgcct

SEQ ID NO: 962 - DNA, 21 bp, synthetic construct
  misc_feature 1..21: note = n-mer motif encoding polynucleotide
  source 1..21: mol_type = other DNA
aatactactccgcctaatcat

SEQ ID NO: 963 - DNA, 21 bp, synthetic construct
  misc_feature 1..21: note = n-mer motif encoding polynucleotide
  source 1..21: mol_type = other DNA
tgcaccgccacaaaatgctca

SEQ ID NO: 964 - DNA, 21 bp, synthetic construct
  misc_feature 1..21: note = n-mer motif encoding polynucleotide
  source 1..21: mol_type = other DNA
cacagtgacatggtcagcggc

SEQ ID NO: 965 - DNA, 21 bp, synthetic construct
  misc_feature 1..21: note = n-mer motif encoding polynucleotide
  source 1..21: mol_type = other DNA
ccaaacgcacaccacctgccc

SEQ ID NO: 966 - DNA, 21 bp, synthetic construct
  misc_feature 1..21: note = n-mer motif encoding polynucleotide
  source 1..21: mol_type = other DNA
tctaataatatgaatcaggcg

SEQ ID NO: 967 - DNA, 21 bp, synthetic construct
  misc_feature 1..21: note = n-mer motif encoding polynucleotide
  source 1..21: mol_type = other DNA
agtgataataatagggctaat

SEQ ID NO: 968 - DNA, 21 bp, synthetic construct
  misc_feature 1..21: note = n-mer motif encoding polynucleotide
  source 1..21: mol_type = other DNA
ttgcagacgcctgggacgacg

SEQ ID NO: 969 - DNA, 21 bp, synthetic construct
  misc_feature 1..21: note = n-mer motif encoding polynucleotide
  source 1..21: mol_type = other DNA
gtgcgcggcgttcaagacgcc

SEQ ID NO: 970 - DNA, 21 bp, synthetic construct
  misc_feature 1..21: note = n-mer motif encoding polynucleotide
  source 1..21: mol_type = other DNA
tctctagactcgcgctcctcg

SEQ ID NO: 971 - DNA, 21 bp, synthetic construct
  misc_feature 1..21: note = n-mer motif encoding polynucleotide
  source 1..21: mol_type = other DNA
gtttgtgttactacttgtgct

SEQ ID NO: 972 - DNA, 21 bp, synthetic construct
  misc_feature 1..21: note = n-mer motif encoding polynucleotide
  source 1..21: mol_type = other DNA
ccgaatactaatcatcttgtg

SEQ ID NO: 973 - DNA, 21 bp, synthetic construct
  misc_feature 1..21: note = n-mer motif encoding polynucleotide
  source 1..21: mol_type = other DNA
ctcatgtcagggaaagaaaac

SEQ ID NO: 974 - DNA, 21 bp, synthetic construct
  misc_feature 1..21: note = n-mer motif encoding polynucleotide
  source 1..21: mol_type = other DNA
acttctgctagtgagaattgg

SEQ ID NO: 975 - DNA, 21 bp, synthetic construct
  misc_feature 1..21: note = n-mer motif encoding polynucleotide
  source 1..21: mol_type = other DNA
tttttgccgcagctggggcag

SEQ ID NO: 976 - DNA, 21 bp, synthetic construct
  misc_feature 1..21: note = n-mer motif encoding polynucleotide
  source 1..21: mol_type = other DNA
ccttttaatcctgggaatgtg

SEQ ID NO: 977 - DNA, 21 bp, synthetic construct
  misc_feature 1..21: note = n-mer motif encoding polynucleotide
  source 1..21: mol_type = other DNA
gggacacctggtcaaagtata

SEQ ID NO: 978 - DNA, 21 bp, synthetic construct
  misc_feature 1..21: note = n-mer motif encoding polynucleotide
  source 1..21: mol_type = other DNA
tataataatggtgggcatgtt

SEQ ID NO: 979 - DNA, 21 bp, synthetic construct
  misc_feature 1..21: note = n-mer motif encoding polynucleotide
  source 1..21: mol_type = other DNA
ctcggaaaccactacacaccc

SEQ ID NO: 980 - DNA, 21 bp, synthetic construct
  misc_feature 1..21: note = n-mer motif encoding polynucleotide
  source 1..21: mol_type = other DNA
caagtcaaccaaccgagaata

SEQ ID NO: 981 - DNA, 21 bp, synthetic construct
  misc_feature 1..21: note = n-mer motif encoding polynucleotide
  source 1..21: mol_type = other DNA
ttaggaaacaaccggccacta

SEQ ID NO: 982 - DNA, 21 bp, synthetic construct
  misc_feature 1..21: note = n-mer motif encoding polynucleotide
  source 1..21: mol_type = other DNA
cctccggaaagtgccaggggc

SEQ ID NO: 983 - DNA, 21 bp, synthetic construct
  misc_feature 1..21: note = n-mer motif encoding polynucleotide
  source 1..21: mol_type = other DNA
aaatctgtaggcgacgggaga

SEQ ID NO: 984 - DNA, 21 bp, synthetic construct
  misc_feature 1..21: note = n-mer motif encoding polynucleotide
  source 1..21: mol_type = other DNA
tcacttcggacggacgaattc

SEQ ID NO: 985 - DNA, 21 bp, synthetic construct
  misc_feature 1..21: note = n-mer motif encoding polynucleotide
  source 1..21: mol_type = other DNA
agtactactaatgttgcgtat

SEQ ID NO: 986 - DNA, 21 bp, synthetic construct
  misc_feature 1..21: note = n-mer motif encoding polynucleotide
  source 1..21: mol_type = other DNA
aggatgtcggatcctagtgat

SEQ ID NO: 987 - DNA, 21 bp, synthetic construct
  misc_feature 1..21: note = n-mer motif encoding polynucleotide
  source 1..21: mol_type = other DNA
agtctgtctattacttcggcg

SEQ ID NO: 988 - DNA, 21 bp, synthetic construct
  misc_feature 1..21: note = n-mer motif encoding polynucleotide
  source 1..21: mol_type = other DNA
gaaagtgccacatctctaaaa

SEQ ID NO: 989 - DNA, 21 bp, synthetic construct
  misc_feature 1..21: note = n-mer motif encoding polynucleotide
  source 1..21: mol_type = other DNA
tacactgacggaagaaacacc

SEQ ID NO: 990 - DNA, 21 bp, synthetic construct
  misc_feature 1..21: note = n-mer motif encoding polynucleotide
  source 1..21: mol_type = other DNA
tccatatccaacctgcgtacc

SEQ ID NO: 991 - DNA, 21 bp, synthetic construct
  misc_feature 1..21: note = n-mer motif encoding polynucleotide
  source 1..21: mol_type = other DNA
caaaacgacaaatctgacaac

SEQ ID NO: 992 - DNA, 21 bp, synthetic construct
  misc_feature 1..21: note = n-mer motif encoding polynucleotide
  source 1..21: mol_type = other DNA
ggtggaacaggtctttccaaa

SEQ ID NO: 993 - DNA, 21 bp, synthetic construct
  misc_feature 1..21: note = n-mer motif encoding polynucleotide
  source 1..21: mol_type = other DNA
agtcaggctcagattcgtgtt

SEQ ID NO: 994 - DNA, 21 bp, synthetic construct
  misc_feature 1..21: note = n-mer motif encoding polynucleotide
  source 1..21: mol_type = other DNA
ggtttgatggcgcatgtgact

SEQ ID NO: 995 - DNA, 21 bp, synthetic construct
  misc_feature 1..21: note = n-mer motif encoding polynucleotide
  source 1..21: mol_type = other DNA
ctggttgtttcgaatagtctg

SEQ ID NO: 996 - DNA, 21 bp, synthetic construct
  misc_feature 1..21: note = n-mer motif encoding polynucleotide
  source 1..21: mol_type = other DNA
catgattctgtgaatacggcg

SEQ ID NO: 997 - DNA, 21 bp, synthetic construct
  misc_feature 1..21: note = n-mer motif encoding polynucleotide
  source 1..21: mol_type = other DNA
actcttgcgaaggatgggaat

SEQ ID NO: 998 - DNA, 21 bp, synthetic construct
  misc_feature 1..21: note = n-mer motif encoding polynucleotide
  source 1..21: mol_type = other DNA
tccgacggatcgaaactacta

SEQ ID NO: 999 - DNA, 21 bp, synthetic construct
  misc_feature 1..21: note = n-mer motif encoding polynucleotide
  source 1..21: mol_type = other DNA
atagacaaaacgttctcggtc

SEQ ID NO: 1000 - DNA, 21 bp, synthetic construct
  misc_feature 1..21: note = n-mer motif encoding polynucleotide
  source 1..21: mol_type = other DNA
cggctggttaacatcgaccac

SEQ ID NO: 1001 - DNA, 21 bp, synthetic construct
  misc_feature 1..21: note = n-mer motif encoding polynucleotide
  source 1..21: mol_type = other DNA
aaaaactacgacagtgactca

SEQ ID NO: 1002 - DNA, 21 bp, synthetic construct
  misc_feature 1..21: note = n-mer motif encoding polynucleotide
  source 1..21: mol_type = other DNA
agtacgcagagtactaatccg

SEQ ID NO: 1003 - DNA, 21 bp, synthetic construct
  misc_feature 1..21: note = n-mer motif encoding polynucleotide
  source 1..21: mol_type = other DNA
caaatatcactacaactcggc

SEQ ID NO: 1004 - DNA, 21 bp, synthetic construct
  misc_feature 1..21: note = n-mer motif encoding polynucleotide
  source 1..21: mol_type = other DNA
tccgaaccccttagagttgga

SEQ ID NO: 1005 - DNA, 21 bp, synthetic construct
  misc_feature 1..21: note = n-mer motif encoding polynucleotide
  source 1..21: mol_type = other DNA
agtcgtctgcagactcagcag

SEQ ID NO: 1006 - DNA, 21 bp, synthetic construct
  misc_feature 1..21: note = n-mer motif encoding polynucleotide
  source 1..21: mol_type = other DNA
gaaggttcacaaggaaaccac

SEQ ID NO: 1007 - DNA, 21 bp, synthetic construct
  misc_feature 1..21: note = n-mer motif encoding polynucleotide
  source 1..21: mol_type = other DNA
cgttctgaccttactgaaagt

SEQ ID NO: 1008 - DNA, 21 bp, synthetic construct
  misc_feature 1..21: note = n-mer motif encoding polynucleotide
  source 1..21: mol_type = other DNA
catactggtgttcagactaat

SEQ ID NO: 1009 - DNA, 21 bp, synthetic construct
  misc_feature 1..21: note = n-mer motif encoding polynucleotide
  source 1..21: mol_type = other DNA
gagttggatcatctttcgcat

SEQ ID NO: 1010 - DNA, 21 bp, synthetic construct
  misc_feature 1..21: note = n-mer motif encoding polynucleotide
  source 1..21: mol_type = other DNA
gttactggtgttgattatgcg

SEQ ID NO: 1011 - DNA, 21 bp, synthetic construct
  misc_feature 1..21: note = n-mer motif encoding polynucleotide
  source 1..21: mol_type = other DNA
ggcggcgcacacactcgtgta

SEQ ID NO: 1012 - DNA, 21 bp, synthetic construct
  misc_feature 1..21: note = n-mer motif encoding polynucleotide
  source 1..21: mol_type = other DNA
gcctacggtatacacgaagtg

SEQ ID NO: 1013 - DNA, 21 bp, synthetic construct
  misc_feature 1..21: note = n-mer motif encoding polynucleotide
  source 1..21: mol_type = other DNA
gcgatgctgcgtatggagcag

SEQ ID NO: 1014 - DNA, 21 bp, synthetic construct
  misc_feature 1..21: note = n-mer motif encoding polynucleotide
  source 1..21: mol_type = other DNA
aggcaggcgaatcagacgtat

SEQ ID NO: 1015 - DNA, 21 bp, synthetic construct
  misc_feature 1..21: note = n-mer motif encoding polynucleotide
  source 1..21: mol_type = other DNA
ttttctggtcaggcgttggct

SEQ ID NO: 1016 - DNA, 21 bp, synthetic construct
  misc_feature 1..21: note = n-mer motif encoding polynucleotide
  source 1..21: mol_type = other DNA
gataatgtgaattctcagcct

SEQ ID NO: 1017 - DNA, 21 bp, synthetic construct
  misc_feature 1..21: note = n-mer motif encoding polynucleotide
  source 1..21: mol_type = other DNA
gggttgcatgggacgagtaat

SEQ ID NO: 1018 - DNA, 21 bp, synthetic construct
  misc_feature 1..21: note = n-mer motif encoding polynucleotide
  source 1..21: mol_type = other DNA
gagagggagcctcctaagaat

SEQ ID NO: 1019 - DNA, 21 bp, synthetic construct
  misc_feature 1..21: note = n-mer motif encoding polynucleotide
  source 1..21: mol_type = other DNA
gtggtgacgcttgggatgctg

SEQ ID NO: 1020 - DNA, 21 bp, synthetic construct
  misc_feature 1..21: note = n-mer motif encoding polynucleotide
  source 1..21: mol_type = other DNA
cataataataatttgctgaat

SEQ ID NO: 1021 - DNA, 21 bp, synthetic construct
  misc_feature 1..21: note = n-mer motif encoding polynucleotide
  source 1..21: mol_type = other DNA
ttgattaatatgagtcagaat

SEQ ID NO: 1022 - DNA, 21 bp, synthetic construct
  misc_feature 1..21: note = n-mer motif encoding polynucleotide
  source 1..21: mol_type = other DNA
aatactaatgcgtcgtattct

SEQ ID NO: 1023 - DNA, 21 bp, synthetic construct
  misc_feature 1..21: note = n-mer motif encoding polynucleotide
  source 1..21: mol_type = other DNA
aggcttaatgcgggtgagcat

SEQ ID NO: 1024 - DNA, 21 bp, synthetic construct
  misc_feature 1..21: note = n-mer motif encoding polynucleotide
  source 1..21: mol_type = other DNA
gctgttattctgaatcctgtt

SEQ ID NO: 1025 - DNA, 21 bp, synthetic construct
  misc_feature 1..21: note = n-mer motif encoding polynucleotide
  source 1..21: mol_type = other DNA
ccgagtactcatgggtatgtt

SEQ ID NO: 1026 - DNA, 21 bp, synthetic construct
  misc_feature 1..21: note = n-mer motif encoding polynucleotide
  source 1..21: mol_type = other DNA
cttagggcgtctgtgtcggag

SEQ ID NO: 1027 - DNA, 21 bp, synthetic construct
  misc_feature 1..21: note = n-mer motif encoding polynucleotide
  source 1..21: mol_type = other DNA
atgatgacctctatgacgtta

SEQ ID NO: 1028 - DNA, 21 bp, synthetic construct
  misc_feature 1..21: note = n-mer motif encoding polynucleotide
  source 1..21: mol_type = other DNA
tcggcacacaacatagtatac

SEQ ID NO: 1029 - DNA, 21 bp, synthetic construct
  misc_feature 1..21: note = n-mer motif encoding polynucleotide
  source 1..21: mol_type = other DNA
cacgacagcacaacccgccca

SEQ ID NO: 1030 - DNA, 21 bp, synthetic construct
  misc_feature 1..21: note = n-mer motif encoding polynucleotide
  source 1..21: mol_type = other DNA
atcaaagactcgtaccttact

SEQ ID NO: 1031 - DNA, 21 bp, synthetic construct
  misc_feature 1..21: note = n-mer motif encoding polynucleotide
  source 1..21: mol_type = other DNA
tatacgcctgggcttactgag

SEQ ID NO: 1032 - DNA, 21 bp, synthetic construct
  misc_feature 1..21: note = n-mer motif encoding polynucleotide
  source 1..21: mol_type = other DNA
aagatgggtggttctcagagt

SEQ ID NO: 1033 - DNA, 21 bp, synthetic construct
  misc_feature 1..21: note = n-mer motif encoding polynucleotide
  source 1..21: mol_type = other DNA
tcacgtcaaacagcgctaaca

SEQ ID NO: 1034 - DNA, 21 bp, synthetic construct
  misc_feature 1..21: note = n-mer motif encoding polynucleotide
  source 1..21: mol_type = other DNA
gtagaaaccagcagattgtac

SEQ ID NO: 1035 - DNA, 21 bp, synthetic construct
  misc_feature 1..21: note = n-mer motif encoding polynucleotide
  source 1..21: mol_type = other DNA
aaatccaacaacggggaatac

SEQ ID NO: 1036 - DNA, 21 bp, synthetic construct
  misc_feature 1..21: note = n-mer motif encoding polynucleotide
  source 1..21: mol_type = other DNA
tcgggtgttcatagtgcgcgt

SEQ ID NO: 1037 - DNA, 21 bp, synthetic construct
  misc_feature 1..21: note = n-mer motif encoding polynucleotide
  source 1..21: mol_type = other DNA
cctaacaacgaaaaaaacccg

SEQ ID NO: 1038 - DNA, 21 bp, synthetic construct
  misc_feature 1..21: note = n-mer motif encoding polynucleotide
  source 1..21: mol_type = other DNA
actattggtgaggggtatcat

SEQ ID NO: 1039 - DNA, 21 bp, synthetic construct
  misc_feature 1..21: note = n-mer motif encoding polynucleotide
  source 1..21: mol_type = other DNA
ctgcagacttctgttgctact

SEQ ID NO: 1040 - DNA, 21 bp, synthetic construct
  misc_feature 1..21: note = n-mer motif encoding polynucleotide
  source 1..21: mol_type = other DNA
ctattgggaaacgcacccaca

SEQ ID NO: 1041 - DNA, 21 bp, synthetic construct
  misc_feature 1..21: note = n-mer motif encoding polynucleotide
  source 1..21: mol_type = other DNA
atttcggggtctcatttgaat

SEQ ID NO: 1042 - DNA, 21 bp, synthetic construct
  misc_feature 1..21: note = n-mer motif encoding polynucleotide
  source 1..21: mol_type = other DNA
aagtctcttagtagtgatgat

SEQ ID NO: 1043 - DNA, 21 bp, synthetic construct
  misc_feature 1..21: note = n-mer motif encoding polynucleotide
  source 1..21: mol_type = other DNA
acgaggactcaggggacgtct

SEQ ID NO: 1044 - DNA, 21 bp, synthetic construct
  misc_feature 1..21: note = n-mer motif encoding polynucleotide
  source 1..21: mol_type = other DNA
gttagtaggtctgggagtact

SEQ ID NO: 1045 - DNA, 21 bp, synthetic construct
  misc_feature 1..21: note = n-mer motif encoding polynucleotide
  source 1..21: mol_type = other DNA
agcgccgacacccggtccccc

SEQ ID NO: 1046 - DNA, 21 bp, synthetic construct
  misc_feature 1..21: note = n-mer motif encoding polynucleotide
  source 1..21: mol_type = other DNA
cgtgatactgctaatgggccg

SEQ ID NO: 1047 - DNA, 21 bp, synthetic construct
  misc_feature 1..21: note = n-mer motif encoding polynucleotide
  source 1..21: mol_type = other DNA
atgatgtctaacagcctcgcg

SEQ ID NO: 1048 - DNA, 21 bp, synthetic construct
  misc_feature 1..21: note = n-mer motif encoding polynucleotide
  source 1..21: mol_type = other DNA
actgggaggattgagcttagg

SEQ ID NO: 1049 - DNA, 21 bp, synthetic construct
  misc_feature 1..21: note = n-mer motif encoding polynucleotide
  source 1..21: mol_type = other DNA
gctaataatgcggctgcgtcg

SEQ ID NO: 1050 - DNA, 21 bp, synthetic construct
  misc_feature 1..21: note = n-mer motif encoding polynucleotide
  source 1..21: mol_type = other DNA
cagttgaatattaatgataag

SEQ ID NO: 1051 - DNA, 21 bp, synthetic construct
  misc_feature 1..21: note = n-mer motif encoding polynucleotide
  source 1..21: mol_type = other DNA
atggacggggctcacacgtca

SEQ ID NO: 1052 - DNA, 21 bp, synthetic construct
  misc_feature 1..21: note = n-mer motif encoding polynucleotide
  source 1..21: mol_type = other DNA
actagtgcgactgattcgatg

SEQ ID NO: 1053 - DNA, 21 bp, synthetic construct
  misc_feature 1..21: note = n-mer motif encoding polynucleotide
  source 1..21: mol_type = other DNA
gccgccagcttgtcgcaaagc

SEQ ID NO: 1054 - DNA, 21 bp, synthetic construct
  misc_feature 1..21: note = n-mer motif encoding polynucleotide
  source 1..21: mol_type = other DNA
tctcaggcgggtctgcttgtg

SEQ ID NO: 1055 - DNA, 21 bp, synthetic construct
  misc_feature 1..21: note = n-mer motif encoding polynucleotide
  source 1..21: mol_type = other DNA
acgacttattcggatctgagt

SEQ ID NO: 1056 - DNA, 21 bp, synthetic construct
  misc_feature 1..21: note = n-mer motif encoding polynucleotide
  source 1..21: mol_type = other DNA
ttctcctccggaacaaccata

SEQ ID NO: 1057 - DNA, 21 bp, synthetic construct
  misc_feature 1..21: note = n-mer motif encoding polynucleotide
  source 1..21: mol_type = other DNA
gtcttcacagaaatagaatcg

SEQ ID NO: 1058 - DNA, 21 bp, synthetic construct
  misc_feature 1..21: note = n-mer motif encoding polynucleotide
  source 1..21: mol_type = other DNA
gcagaccccgctaaaggcaaa

SEQ ID NO: 1059 - DNA, 21 bp, synthetic construct
  misc_feature 1..21: note = n-mer motif encoding polynucleotide
  source 1..21: mol_type = other DNA
aaagaatctgaatacagagtt

SEQ ID NO: 1060 - DNA, 21 bp, synthetic construct
  misc_feature 1..21: note = n-mer motif encoding polynucleotide
  source 1..21: mol_type = other DNA
gggatggtgtctcttaatagg

SEQ ID NO: 1061 - DNA, 21 bp, synthetic construct
  misc_feature 1..21: note = n-mer motif encoding polynucleotide
  source 1..21: mol_type = other DNA
accgttatcgaacgcaaagac

SEQ ID NO: 1062 - DNA, 21 bp, synthetic construct
  misc_feature 1..21: note = n-mer motif encoding polynucleotide
  source 1..21: mol_type = other DNA
aggattgatacgttgttggtg

SEQ ID NO: 1063 - DNA, 21 bp, synthetic construct
  misc_feature 1..21: note = n-mer motif encoding polynucleotide
  source 1..21: mol_type = other DNA
ggatccacaggcctacccccg

SEQ ID NO: 1064 - DNA, 21 bp, synthetic construct
  misc_feature 1..21: note = n-mer motif encoding polynucleotide
  source 1..21: mol_type = other DNA
atggagttgacttctactagt

SEQ ID NO: 1065 - DNA, 21 bp, synthetic construct
  misc_feature 1..21: note = n-mer motif encoding polynucleotide
  source 1..21: mol_type = other DNA
caaccaggagccccccaaacc

SEQ ID NO: 1066 - DNA, 21 bp, synthetic construct
  misc_feature 1..21: note = n-mer motif encoding polynucleotide
  source 1..21: mol_type = other DNA
aattcgatgggtaatgggggt

SEQ ID NO: 1067 - DNA, 21 bp, synthetic construct
  misc_feature 1..21: note = n-mer motif encoding polynucleotide
  source 1..21: mol_type = other DNA
ggtagtactaagtctgggcag

SEQ ID NO: 1068 - DNA, 21 bp, synthetic construct
  misc_feature 1..21: note = n-mer motif encoding polynucleotide
  source 1..21: mol_type = other DNA
acttttttgcctcagcttggg

SEQ ID NO: 1069 - DNA, 21 bp, synthetic construct
  misc_feature 1..21: note = n-mer motif encoding polynucleotide
  source 1..21: mol_type = other DNA
atgggaataaacgtactgagc

SEQ ID NO: 1070 - DNA, 21 bp, synthetic construct
  misc_feature 1..21: note = n-mer motif encoding polynucleotide
  source 1..21: mol_type = other DNA
gtgaatcttggtatttcgggg

SEQ ID NO: 1071 - DNA, 21 bp, synthetic construct
  misc_feature 1..21: note = n-mer motif encoding polynucleotide
  source 1..21: mol_type = other DNA
agtgagaatcgggctggtaat

SEQ ID NO: 1072 - DNA, 21 bp, synthetic construct
  misc_feature 1..21: note = n-mer motif encoding polynucleotide
  source 1..21: mol_type = other DNA
cactccaacgcgactacgata

SEQ ID NO: 1073 - DNA, 21 bp, synthetic construct
  misc_feature 1..21: note = n-mer motif encoding polynucleotide
  source 1..21: mol_type = other DNA
ccggggtcgtccgcttccatc

SEQ ID NO: 1074 - DNA, 21 bp, synthetic construct
  misc_feature 1..21: note = n-mer motif encoding polynucleotide
  source 1..21: mol_type = other DNA
attacgtcgttgaatgggatg

SEQ ID NO: 1075 - DNA, 21 bp, synthetic construct
  misc_feature 1..21: note = n-mer motif encoding polynucleotide
  source 1..21: mol_type = other DNA
tatctggagggtgctcatcgt

SEQ ID NO: 1076 - DNA, 21 bp, synthetic construct
  misc_feature 1..21: note = n-mer motif encoding polynucleotide
  source 1..21: mol_type = other DNA
aggcaggttgagcagtctgat

SEQ ID NO: 1077 - DNA, 21 bp, synthetic construct
  misc_feature 1..21: note = n-mer motif encoding polynucleotide
  source 1..21: mol_type = other DNA
agctctcaaagttccgggtcg

SEQ ID NO: 1078 - DNA, 21 bp, synthetic construct
  misc_feature 1..21: note = n-mer motif encoding polynucleotide
  source 1..21: mol_type = other DNA
cagcttactgttgggaagccg

SEQ ID NO: 1079 - DNA, 21 bp, synthetic construct
  misc_feature 1..21: note = n-mer motif encoding polynucleotide
  source 1..21: mol_type = other DNA
gttgtgcattcgagtattact

SEQ ID NO: 1080 - DNA, 21 bp, synthetic construct
  misc_feature 1..21: note = n-mer motif encoding polynucleotide
  source 1..21: mol_type = other DNA
ctagaacaactacgggtccca

SEQ ID NO: 1081 - DNA, 21 bp, synthetic construct
  misc_feature 1..21: note = n-mer motif encoding polynucleotide
  source 1..21: mol_type = other DNA
cagcattctccgaagccggtt

SEQ ID NO: 1082 - DNA, 21 bp, synthetic construct
  misc_feature 1..21: note = n-mer motif encoding polynucleotide
  source 1..21: mol_type = other DNA
gcgggcagttcgccatcacgc

SEQ ID NO: 1083 - DNA, 21 bp, synthetic construct
  misc_feature 1..21: note = n-mer motif encoding polynucleotide
  source 1..21: mol_type = other DNA
ggagtaacaatcggtagcagg

SEQ ID NO: 1084 - DNA, 21 bp, synthetic construct
  misc_feature 1..21: note = n-mer motif encoding polynucleotide
  source 1..21: mol_type = other DNA
tacatcgcgggaggcgaccaa

SEQ ID NO: 1085 - DNA, 21 bp, synthetic construct
  misc_feature 1..21: note = n-mer motif encoding polynucleotide
  source 1..21: mol_type = other DNA
attagtagtgagaggttttct

SEQ ID NO: 1086 - DNA, 21 bp, synthetic construct
  misc_feature 1..21: note = n-mer motif encoding polynucleotide
  source 1..21: mol_type = other DNA
aggagtgagggtaatcatgct

SEQ ID NO: 1087 - DNA, 21 bp, synthetic construct
  misc_feature 1..21: note = n-mer motif encoding polynucleotide
  source 1..21: mol_type = other DNA
gagaaggggaatagtggggtt

SEQ ID NO: 1088 - DNA, 21 bp, synthetic construct
  misc_feature 1..21: note = n-mer motif encoding polynucleotide
  source 1..21: mol_type = other DNA
tacatagttgaccacgctaac

SEQ ID NO: 1089 - DNA, 21 bp, synthetic construct
  misc_feature 1..21: note = n-mer motif encoding polynucleotide
  source 1..21: mol_type = other DNA
cgtcggttgagtacggatctt

SEQ ID NO: 1090 - DNA, 21 bp, synthetic construct
  misc_feature 1..21: note = n-mer motif encoding polynucleotide
  source 1..21: mol_type = other DNA
gcgaatagtaggcttggggcg

SEQ ID NO: 1091 - DNA, 21 bp, synthetic construct
  misc_feature 1..21: note = n-mer motif encoding polynucleotide
  source 1..21: mol_type = other DNA
ggtactgctgagaatacgagt

SEQ ID NO: 1092 - DNA, 21 bp, synthetic construct
  misc_feature 1..21: note = n-mer motif encoding polynucleotide
  source 1..21: mol_type = other DNA
gtgagggatgttgctaaggag

SEQ ID NO: 1093 - DNA, 21 bp, synthetic construct
  misc_feature 1..21: note = n-mer motif encoding polynucleotide
  source 1..21: mol_type = other DNA
ggaggccttaccaacggtcta

SEQ ID NO: 1094 - DNA, 21 bp, synthetic construct
  misc_feature 1..21: note = n-mer motif encoding polynucleotide
  source 1..21: mol_type = other DNA
ccttcgattccgtcgttttcg

SEQ ID NO: 1095 - DNA, 21 bp, synthetic construct
  misc_feature 1..21: note = n-mer motif encoding polynucleotide
  source 1..21: mol_type = other DNA
aacgctctcctcaacgcacct

SEQ ID NO: 1096 - DNA, 21 bp, synthetic construct
  misc_feature 1..21: note = n-mer motif encoding polynucleotide
  source 1..21: mol_type = other DNA
gacgacatggtcaaaaactca

SEQ ID NO: 1097 - DNA, 21 bp, synthetic construct
  misc_feature 1..21: note = n-mer motif encoding polynucleotide
  source 1..21: mol_type = other DNA
actgcgaatacgcatgctctg

SEQ ID NO: 1098 - DNA, 21 bp, synthetic construct
  misc_feature 1..21: note = n-mer motif encoding polynucleotide
  source 1..21: mol_type = other DNA
gtatacgccaccgcactcgca

SEQ ID NO: 1099 - DNA, 21 bp, synthetic construct
  misc_feature 1..21: note = n-mer motif encoding polynucleotide
  source 1..21: mol_type = other DNA
ggtatatacccggcatccacc

SEQ ID NO: 1100 - DNA, 21 bp, synthetic construct
  misc_feature 1..21: note = n-mer motif encoding polynucleotide
  source 1..21: mol_type = other DNA
ggttttgatggtaagcagctt

SEQ ID NO: 1101 - DNA, 21 bp, synthetic construct
  misc_feature 1..21: note = n-mer motif encoding polynucleotide
  source 1..21: mol_type = other DNA
cactctatgtccgcaaacacc

SEQ ID NO: 1102 - DNA, 21 bp, synthetic construct
  misc_feature 1..21: note = n-mer motif encoding polynucleotide
  source 1..21: mol_type = other DNA
tggagcatcaaaaaccaaaca

SEQ ID NO: 1103 - DNA, 21 bp, synthetic construct
  misc_feature 1..21: note = n-mer motif encoding polynucleotide
  source 1..21: mol_type = other DNA
accctccacaccaaagaccta

SEQ ID NO: 1104 - DNA, 21 bp, synthetic construct
  misc_feature 1..21: note = n-mer motif encoding polynucleotide
  source 1..21: mol_type = other DNA
tcttatggtaatactcatgat

SEQ ID NO: 1105 - DNA, 21 bp, synthetic construct
  misc_feature 1..21: note = n-mer motif encoding polynucleotide
  source 1..21: mol_type = other DNA
cagtcggggtctctggtgccg

SEQ ID NO: 1106 - DNA, 21 bp, synthetic construct
  misc_feature 1..21: note = n-mer motif encoding polynucleotide
  source 1..21: mol_type = other DNA
aatactttgcagaatagtcat

SEQ ID NO: 1107 - DNA, 21 bp, synthetic construct
  misc_feature 1..21: note = n-mer motif encoding polynucleotide
  source 1..21: mol_type = other DNA
acggctgagtctagtcatccg

SEQ ID NO: 1108 - DNA, 21 bp, synthetic construct
  misc_feature 1..21: note = n-mer motif encoding polynucleotide
  source 1..21: mol_type = other DNA
gcctctacagtctcactctac

SEQ ID NO: 1109 - DNA, 21 bp, synthetic construct
  misc_feature 1..21: note = n-mer motif encoding polynucleotide
  source 1..21: mol_type = other DNA
ctgactgctgttgcgattagt

SEQ ID NO: 1110 - DNA, 21 bp, synthetic construct
  misc_feature 1..21: note = n-mer motif encoding polynucleotide
  source 1..21: mol_type = other DNA
gtctcgggacaaagtgcgtac

SEQ ID NO: 1111 - DNA, 21 bp, synthetic construct
  misc_feature 1..21: note = n-mer motif encoding polynucleotide
  source 1..21: mol_type = other DNA
ggtgaaactaacttcccaact

SEQ ID NO: 1112 - DNA, 21 bp, synthetic construct
  misc_feature 1..21: note = n-mer motif encoding polynucleotide
  source 1..21: mol_type = other DNA
aatgataataggtcgatgaat

SEQ ID NO: 1113 - DNA, 21 bp, synthetic construct
  misc_feature 1..21: note = n-mer motif encoding polynucleotide
  source 1..21: mol_type = other DNA
cgatcaggcgaccctaaaaac

SEQ ID NO: 1114 - DNA, 21 bp, synthetic construct
  misc_feature 1..21: note = n-mer motif encoding polynucleotide
  source 1..21: mol_type = other DNA
tgggagagtgataagtttcgt

SEQ ID NO: 1115 - DNA, 21 bp, synthetic construct
  misc_feature 1..21: note = n-mer motif encoding polynucleotide
  source 1..21: mol_type = other DNA
caggttaatcataatactagt

SEQ ID NO: 1116 - DNA, 21 bp, synthetic construct
  misc_feature 1..21: note = n-mer motif encoding polynucleotide
  source 1..21: mol_type = other DNA
gggtggtcgaacaacgaacta

SEQ ID NO: 1117 - DNA, 21 bp, synthetic construct
  misc_feature 1..21: note = n-mer motif encoding polynucleotide
  source 1..21: mol_type = other DNA
cgggctgtgcttgcgactaat

SEQ ID NO: 1118 - DNA, 21 bp, synthetic construct
  misc_feature 1..21: note = n-mer motif encoding polynucleotide
  source 1..21: mol_type = other DNA
catatgggtttgaatgagctt

SEQ ID NO: 1119 - DNA, 21 bp, synthetic construct
  misc_feature 1..21: note = n-mer motif encoding polynucleotide
  source 1..21: mol_type = other DNA
ggagaaagctcctcaataagc

SEQ ID NO: 1120 - DNA, 21 bp, synthetic construct
  misc_feature 1..21: note = n-mer motif encoding polynucleotide
  source 1..21: mol_type = other DNA
atacacaaatctagcgtcgaa

SEQ ID NO: 1121 - DNA, 21 bp, synthetic construct
  misc_feature 1..21: note = n-mer motif encoding polynucleotide
  source 1..21: mol_type = other DNA
atgtccggatccatgatatca

SEQ ID NO: 1122 - DNA, 21 bp, synthetic construct
  misc_feature 1..21: note = n-mer motif encoding polynucleotide
  source 1..21: mol_type = other DNA
ttgagtctggctgggaatagg

SEQ ID NO: 1123 - DNA, 21 bp, synthetic construct
  misc_feature 1..21: note = n-mer motif encoding polynucleotide
  source 1..21: mol_type = other DNA
tctgcaacaacgaaccacgga

SEQ ID NO: 1124 - DNA, 21 bp, synthetic construct
  misc_feature 1..21: note = n-mer motif encoding polynucleotide
  source 1..21: mol_type = other DNA
tctacggagtctaatgctagt

SEQ ID NO: 1125 - DNA, 21 bp, synthetic construct
  misc_feature 1..21: note = n-mer motif encoding polynucleotide
  source 1..21: mol_type = other DNA
ccgattgctgagaggccttct

SEQ ID NO: 1126 - DNA, 21 bp, synthetic construct
  misc_feature 1..21: note = n-mer motif encoding polynucleotide
  source 1..21: mol_type = other DNA
ttacttccaaacaacacccac

SEQ ID NO: 1127 - DNA, 21 bp, synthetic construct
  misc_feature 1..21: note = n-mer motif encoding polynucleotide
  source 1..21: mol_type = other DNA
gggactcttaagaaggatgcg

SEQ ID NO: 1128 - DNA, 21 bp, synthetic construct
  misc_feature 1..21: note = n-mer motif encoding polynucleotide
  source 1..21: mol_type = other DNA
gctcttgagaatcggagtctg

SEQ ID NO: 1129 - DNA, 21 bp, synthetic construct
  misc_feature 1..21: note = n-mer motif encoding polynucleotide
  source 1..21: mol_type = other DNA
accaccgggaactccacgatg

SEQ ID NO: 1130 - DNA, 21 bp, synthetic construct
  misc_feature 1..21: note = n-mer motif encoding polynucleotide
  source 1..21: mol_type = other DNA
gtgtatgatagtgcgcctaat

SEQ ID NO: 1131 - DNA, 21 bp, synthetic construct
  misc_feature 1..21: note = n-mer motif encoding polynucleotide
  source 1..21: mol_type = other DNA
ctactatctaaaggggactcc

SEQ ID NO: 1132 - DNA, 21 bp, synthetic construct
  misc_feature 1..21: note = n-mer motif encoding polynucleotide
  source 1..21: mol_type = other DNA
tcttacgccataaaccaatca

SEQ ID NO: 1133 - DNA, 21 bp, synthetic construct
  misc_feature 1..21: note = n-mer motif encoding polynucleotide
  source 1..21: mol_type = other DNA
ggaggaggggaacgttccacg

SEQ ID NO: 1134 - DNA, 21 bp, synthetic construct
  misc_feature 1..21: note = n-mer motif encoding polynucleotide
  source 1..21: mol_type = other DNA
attcaggttagtggtagtcag

SEQ ID NO: 1135 - DNA, 21 bp, synthetic construct
  misc_feature 1..21: note = n-mer motif encoding polynucleotide
  source 1..21: mol_type = other DNA
tatcctgtttcgctttcgccg

SEQ ID NO: 1136 - DNA, 21 bp, synthetic construct
  misc_feature 1..21: note = n-mer motif encoding polynucleotide
  source 1..21: mol_type = other DNA
gagttgggtaataagacggct

SEQ ID NO: 1137 - DNA, 21 bp, synthetic construct
  misc_feature 1..21: note = n-mer motif encoding polynucleotide
  source 1..21: mol_type = other DNA
tcgggggtaaacttcggagta

SEQ ID NO: 1138 - DNA, 21 bp, synthetic construct
  misc_feature 1..21: note = n-mer motif encoding polynucleotide
  source 1..21: mol_type = other DNA
gcgtggagttcgccgagtggg

SEQ ID NO: 1139 - DNA, 21 bp, synthetic construct
  misc_feature 1..21: note = n-mer motif encoding polynucleotide
  source 1..21: mol_type = other DNA
ggtgtgaattatcatactacg

SEQ ID NO: 1140 - DNA, 21 bp, synthetic construct
  misc_feature 1..21: note = n-mer motif encoding polynucleotide
  source 1..21: mol_type = other DNA
ctgattggggagcttaagatg

SEQ ID NO: 1141 - DNA, 21 bp, synthetic construct
  misc_feature 1..21: note = n-mer motif encoding polynucleotide
  source 1..21: mol_type = other DNA
tatctgaatagtaagcagctt

SEQ ID NO: 1142 - DNA, 21 bp, synthetic construct
  misc_feature 1..21: note = n-mer motif encoding polynucleotide
  source 1..21: mol_type = other DNA
actgttgataggccgattgtg

SEQ ID NO: 1143 - DNA, 21 bp, synthetic construct
  misc_feature 1..21: note = n-mer motif encoding polynucleotide
  source 1..21: mol_type = other DNA
gtcagcaaaaccaaagactcg

SEQ ID NO: 1144 - DNA, 21 bp, synthetic construct
  misc_feature 1..21: note = n-mer motif encoding polynucleotide
  source 1..21: mol_type = other DNA
caagctgggaacgcgccaagg

SEQ ID NO: 1145 - DNA, 21 bp, synthetic construct
  misc_feature 1..21: note = n-mer motif encoding polynucleotide
  source 1..21: mol_type = other DNA
caagaccaaacgagcaaccgt

SEQ ID NO: 1146 - DNA, 21 bp, synthetic construct
  misc_feature 1..21: note = n-mer motif encoding polynucleotide
  source 1..21: mol_type = other DNA
gatactacgtatcggaatact

SEQ ID NO: 1147 - DNA, 21 bp, synthetic construct
  misc_feature 1..21: note = n-mer motif encoding polynucleotide
  source 1..21: mol_type = other DNA
gggacaaccgaagttaacaaa

SEQ ID NO: 1148 - DNA, 21 bp, synthetic construct
  misc_feature 1..21: note = n-mer motif encoding polynucleotide
  source 1..21: mol_type = other DNA
gggtttactaatacgagtaag

SEQ ID NO: 1149 - DNA, 21 bp, synthetic construct
  misc_feature 1..21: note = n-mer motif encoding polynucleotide
  source 1..21: mol_type = other DNA
gtgcagaagaatgatgtgctt

SEQ ID NO: 1150 - DNA, 21 bp, synthetic construct
  misc_feature 1..21: note = n-mer motif encoding polynucleotide
  source 1..21: mol_type = other DNA
agcgtcaacaacatgcgactc

SEQ ID NO: 1151 - DNA, 21 bp, synthetic construct
  misc_feature 1..21: note = n-mer motif encoding polynucleotide
  source 1..21: mol_type = other DNA
ttcagtgccgccttaccgtta

SEQ ID NO: 1152 - DNA, 21 bp, synthetic construct
  misc_feature 1..21: note = n-mer motif encoding polynucleotide
  source 1..21: mol_type = other DNA
gacgtcccaaacaacaaaagg

SEQ ID NO: 1153 - DNA, 21 bp, synthetic construct
  misc_feature 1..21: note = n-mer motif encoding polynucleotide
  source 1..21: mol_type = other DNA
ggtgagactatgcgtcataat

SEQ ID NO: 1154 - DNA, 21 bp, synthetic construct
  misc_feature 1..21: note = n-mer motif encoding polynucleotide
  source 1..21: mol_type = other DNA
attcggacttctgtgattaat

SEQ ID NO: 1155 - DNA, 21 bp, synthetic construct
  misc_feature 1..21: note = n-mer motif encoding polynucleotide
  source 1..21: mol_type = other DNA
ccgcgtgctcctggtcataat

SEQ ID NO: 1156 - DNA, 21 bp, synthetic construct
  misc_feature 1..21: note = n-mer motif encoding polynucleotide
  source 1..21: mol_type = other DNA
agtgttgcgcatcctttgtct

SEQ ID NO: 1157 - DNA, 21 bp, synthetic construct
  misc_feature 1..21: note = n-mer motif encoding polynucleotide
  source 1..21: mol_type = other DNA
atgacaataaccgtcgaaccg

SEQ ID NO: 1158 - DNA, 21 bp, synthetic construct
  misc_feature 1..21: note = n-mer motif encoding polynucleotide
  source 1..21: mol_type = other DNA
ccattaaacgcgaacggctcc

SEQ ID NO: 1159 - DNA, 21 bp, synthetic construct
  misc_feature 1..21: note = n-mer motif encoding polynucleotide
  source 1..21: mol_type = other DNA
aataggcagcgggattttgag

SEQ ID NO: 1160 - DNA, 21 bp, synthetic construct
  misc_feature 1..21: note = n-mer motif encoding polynucleotide
  source 1..21: mol_type = other DNA
gatattcataatccgcgtacg

SEQ ID NO: 1161 - DNA, 21 bp, synthetic construct
  misc_feature 1..21: note = n-mer motif encoding polynucleotide
  source 1..21: mol_type = other DNA
tggatagcaggaaaccactcc

SEQ ID NO: 1162 - DNA, 21 bp, synthetic construct
  misc_feature 1..21: note = n-mer motif encoding polynucleotide
  source 1..21: mol_type = other DNA
tctactcatcatgctgatcgt

SEQ ID NO: 1163 - DNA, 21 bp, synthetic construct
  misc_feature 1..21: note = n-mer motif encoding polynucleotide
  source 1..21: mol_type = other DNA
ccggaatccgccgccaaaagc

SEQ ID NO: 1164 - DNA, 21 bp, synthetic construct
  misc_feature 1..21: note = n-mer motif encoding polynucleotide
  source 1..21: mol_type = other DNA
cactccgacaaagtctcctca

SEQ ID NO: 1165 - DNA, 21 bp, synthetic construct
  misc_feature 1..21: note = n-mer motif encoding polynucleotide
  source 1..21: mol_type = other DNA
tcaaacagcgccgacgcgggg

SEQ ID NO: 1166 - DNA, 21 bp, synthetic construct
  misc_feature 1..21: note = n-mer motif encoding polynucleotide
  source 1..21: mol_type = other DNA
gagtttcagaggattcgtgag

SEQ ID NO: 1167 - DNA, 21 bp, synthetic construct
  misc_feature 1..21: note = n-mer motif encoding polynucleotide
  source 1..21: mol_type = other DNA
tccgcggggatgacattggac

SEQ ID NO: 1168 - DNA, 21 bp, synthetic construct
  misc_feature 1..21: note = n-mer motif encoding polynucleotide
  source 1..21: mol_type = other DNA
actcaaacttctacctggacc

SEQ ID NO: 1169 - DNA, 21 bp, synthetic construct
  misc_feature 1..21: note = n-mer motif encoding polynucleotide
  source 1..21: mol_type = other DNA
acgacactaacgcaaacggac

SEQ ID NO: 1170 - DNA, 21 bp, synthetic construct
  misc_feature 1..21: note = n-mer motif encoding polynucleotide
  source 1..21: mol_type = other DNA
gcctcgaaaggcttcggccac

SEQ ID NO: 1171 - DNA, 21 bp, synthetic construct
  misc_feature 1..21: note = n-mer motif encoding polynucleotide
  source 1..21: mol_type = other DNA
ccggctacgatgattagtgag

SEQ ID NO: 1172 - DNA, 21 bp, synthetic construct
  misc_feature 1..21: note = n-mer motif encoding polynucleotide
  source 1..21: mol_type = other DNA
actgactcatctgcagactcc

SEQ ID NO: 1173 - DNA, 21 bp, synthetic construct
  misc_feature 1..21: note = n-mer motif encoding polynucleotide
  source 1..21: mol_type = other DNA
tcaaccagaaaagaacacgac

SEQ ID NO: 1174 - DNA, 21 bp, synthetic construct
  misc_feature 1..21: note = n-mer motif encoding polynucleotide
  source 1..21: mol_type = other DNA
ggtgatatttcttatagggtt

SEQ ID NO: 1175 - DNA, 21 bp, synthetic construct
  misc_feature 1..21: note = n-mer motif encoding polynucleotide
  source 1..21: mol_type = other DNA
atggggtatgttgatagtctg

SEQ ID NO: 1176 - DNA, 21 bp, synthetic construct
  misc_feature 1..21: note = n-mer motif encoding polynucleotide
  source 1..21: mol_type = other DNA
caaaccatcacctcacaaatg

SEQ ID NO: 1177 - DNA, 21 bp, synthetic construct
  misc_feature 1..21: note = n-mer motif encoding polynucleotide
  source 1..21: mol_type = other DNA
tcgattgggtattcgcctccg

SEQ ID NO: 1178 - DNA, 21 bp, synthetic construct
  misc_feature 1..21: note = n-mer motif encoding polynucleotide
  source 1..21: mol_type = other DNA
tcatccccagactcgtacaga

SEQ ID NO: 1179 - DNA, 21 bp, synthetic construct
  misc_feature 1..21: note = n-mer motif encoding polynucleotide
  source 1..21: mol_type = other DNA
attagtccgagtgcttctaat

SEQ ID NO: 1180 - DNA, 21 bp, synthetic construct
  misc_feature 1..21: note = n-mer motif encoding polynucleotide
  source 1..21: mol_type = other DNA
tatccggctgatcatcggact

SEQ ID NO: 1181 - DNA, 21 bp, synthetic construct
  misc_feature 1..21: note = n-mer motif encoding polynucleotide
  source 1..21: mol_type = other DNA
cacaccggccaaacaccatca

SEQ ID NO: 1182 - DNA, 21 bp, synthetic construct
  misc_feature 1..21: note = n-mer motif encoding polynucleotide
  source 1..21: mol_type = other DNA
cagacgactattctggctgct

SEQ ID NO: 1183 - DNA, 21 bp, synthetic construct
  misc_feature 1..21: note = n-mer motif encoding polynucleotide
  source 1..21: mol_type = other DNA
gatggtacgaggcaggttcat

SEQ ID NO: 1184 - DNA, 21 bp, synthetic construct
  misc_feature 1..21: note = n-mer motif encoding polynucleotide
  source 1..21: mol_type = other DNA
aggagtagtcctgcgacgaat

SEQ ID NO: 1185 - DNA, 21 bp, synthetic construct
  misc_feature 1..21: note = n-mer motif encoding polynucleotide
  source 1..21: mol_type = other DNA
gcgatgagtcatacgtataag

SEQ ID NO: 1186 - DNA, 21 bp, synthetic construct
  misc_feature 1..21: note = n-mer motif encoding polynucleotide
  source 1..21: mol_type = other DNA
atggcggctccgccggagcat

SEQ ID NO: 1187 - DNA, 21 bp, synthetic construct
  misc_feature 1..21: note = n-mer motif encoding polynucleotide
  source 1..21: mol_type = other DNA
ggtcctagtacttcggaggcg

SEQ ID NO: 1188 - DNA, 21 bp, synthetic construct
  misc_feature 1..21: note = n-mer motif encoding polynucleotide
  source 1..21: mol_type = other DNA
cataatcatgataggtcgtct

SEQ ID NO: 1189 - DNA, 21 bp, synthetic construct
  misc_feature 1..21: note = n-mer motif encoding polynucleotide
  source 1..21: mol_type = other DNA
gtggtcccatcgacccaagca

SEQ ID NO: 1190 - DNA, 21 bp, synthetic construct
  misc_feature 1..21: note = n-mer motif encoding polynucleotide
  source 1..21: mol_type = other DNA
attcctgtgactactcgtaat

SEQ ID NO: 1191 - DNA, 21 bp, synthetic construct
  misc_feature 1..21: note = n-mer motif encoding polynucleotide
  source 1..21: mol_type = other DNA
aaccaactcgtacgcgggaca

SEQ ID NO: 1192 - DNA, 21 bp, synthetic construct
  misc_feature 1..21: note = n-mer motif encoding polynucleotide
  source 1..21: mol_type = other DNA
gggtttgcgcttacgggtacg

SEQ ID NO: 1193 - DNA, 21 bp, synthetic construct
  misc_feature 1..21: note = n-mer motif encoding polynucleotide
  source 1..21: mol_type = other DNA
tctaagggtggtgatatggtg

SEQ ID NO: 1194 - DNA, 21 bp, synthetic construct
  misc_feature 1..21: note = n-mer motif encoding polynucleotide
  source 1..21: mol_type = other DNA
gctcgaccaggccaatctatg

SEQ ID NO: 1195 - DNA, 21 bp, synthetic construct
  misc_feature 1..21: note = n-mer motif encoding polynucleotide
  source 1..21: mol_type = other DNA
aaagcagactacgaatcctcc

SEQ ID NO: 1196 - DNA, 21 bp, synthetic construct
  misc_feature 1..21: note = n-mer motif encoding polynucleotide
  source 1..21: mol_type = other DNA
ggaccaagttcgcacatcgtt

SEQ ID NO: 1197 - DNA, 21 bp, synthetic construct
  misc_feature 1..21: note = n-mer motif encoding polynucleotide
  source 1..21: mol_type = other DNA
gaagttgtcaaaaccacgcac

SEQ ID NO: 1198 - DNA, 21 bp, synthetic construct
  misc_feature 1..21: note = n-mer motif encoding polynucleotide
  source 1..21: mol_type = other DNA
actttggataataatcattct

SEQ ID NO: 1199 - DNA, 21 bp, synthetic construct
  misc_feature 1..21: note = n-mer motif encoding polynucleotide
  source 1..21: mol_type = other DNA
acgatttataatatgggtccg

SEQ ID NO: 1200 - DNA, 21 bp, synthetic construct
  misc_feature 1..21: note = n-mer motif encoding polynucleotide
  source 1..21: mol_type = other DNA
tctaccatgaacacgatcacg

SEQ ID NO: 1201 - DNA, 21 bp, synthetic construct
  misc_feature 1..21: note = n-mer motif encoding polynucleotide
  source 1..21: mol_type = other DNA
acgctggcgcggactactgag

SEQ ID NO: 1202 - DNA, 21 bp, synthetic construct
  misc_feature 1..21: note = n-mer motif encoding polynucleotide
  source 1..21: mol_type = other DNA
ttgatttcttcgcagacttct

SEQ ID NO: 1203 - DNA, 21 bp, synthetic construct
  misc_feature 1..21: note = n-mer motif encoding polynucleotide
  source 1..21: mol_type = other DNA
cagactgcgtctggtgatact

SEQ ID NO: 1204 - DNA, 21 bp, synthetic construct
  misc_feature 1..21: note = n-mer motif encoding polynucleotide
  source 1..21: mol_type = other DNA
gcgcatggtgcttttccggtt

SEQ ID NO: 1205 - DNA, 21 bp, synthetic construct
  misc_feature 1..21: note = n-mer motif encoding polynucleotide
  source 1..21: mol_type = other DNA
ggggagacgcggtcgactgct

SEQ ID NO: 1206 - DNA, 21 bp, synthetic construct
  misc_feature 1..21: note = n-mer motif encoding polynucleotide
  source 1..21: mol_type = other DNA
aacaactacgcctactccgct

SEQ ID NO: 1207 - DNA, 21 bp, synthetic construct
  misc_feature 1..21: note = n-mer motif encoding polynucleotide
  source 1..21: mol_type = other DNA
gaggcttatcagactgagaag

SEQ ID NO: 1208 - DNA, 21 bp, synthetic construct
  misc_feature 1..21: note = n-mer motif encoding polynucleotide
  source 1..21: mol_type = other DNA
tctctagcacacgccgtaagc

SEQ ID NO: 1209 - DNA, 21 bp, synthetic construct
  misc_feature 1..21: note = n-mer motif encoding polynucleotide
  source 1..21: mol_type = other DNA
acgtatcagttgagtgggaat

SEQ ID NO: 1210 - DNA, 21 bp, synthetic construct
  misc_feature 1..21: note = n-mer motif encoding polynucleotide
  source 1..21: mol_type = other DNA
atgagcgaaaggttgcggata

SEQ ID NO: 1211 - DNA, 21 bp, synthetic construct
  misc_feature 1..21: note = n-mer motif encoding polynucleotide
  source 1..21: mol_type = other DNA
gggtcggggaaagacccaggg

SEQ ID NO: 1212 - DNA, 21 bp, synthetic construct
  misc_feature 1..21: note = n-mer motif encoding polynucleotide
  source 1..21: mol_type = other DNA
tacaacagcaacgcttctgta

SEQ ID NO: 1213 - DNA, 21 bp, synthetic construct
  misc_feature 1..21: note = n-mer motif encoding polynucleotide
  source 1..21: mol_type = other DNA
acgaggggtgatatggagttt

SEQ ID NO: 1214 - DNA, 21 bp, synthetic construct
  misc_feature 1..21: note = n-mer motif encoding polynucleotide
  source 1..21: mol_type = other DNA
ggaatcaccggaagccccggc

SEQ ID NO: 1215 - DNA, 21 bp, synthetic construct
  misc_feature 1..21: note = n-mer motif encoding polynucleotide
  source 1..21: mol_type = other DNA
caacacaccgcccaccccatg

SEQ ID NO: 1216 - DNA, 21 bp, synthetic construct
  misc_feature 1..21: note = n-mer motif encoding polynucleotide
  source 1..21: mol_type = other DNA
gatacggcgaatcgttcgact

SEQ ID NO: 1217 - DNA, 21 bp, synthetic construct
  misc_feature 1..21: note = n-mer motif encoding polynucleotide
  source 1..21: mol_type = other DNA
tcggcacacgacgcaagacta

SEQ ID NO: 1218 - DNA, 21 bp, synthetic construct
  misc_feature 1..21: note = n-mer motif encoding polynucleotide
  source 1..21: mol_type = other DNA
cttaatcatactctggggcat

SEQ ID NO: 1219 - DNA, 21 bp, synthetic construct
  misc_feature 1..21: note = n-mer motif encoding polynucleotide
  source 1..21: mol_type = other DNA
gggtttgagacgagtagtcct

SEQ ID NO: 1220 - DNA, 21 bp, synthetic construct
  misc_feature 1..21: note = n-mer motif encoding polynucleotide
  source 1..21: mol_type = other DNA
ggtacgagtgcggagagtcgg

SEQ ID NO: 1221 - DNA, 21 bp, synthetic construct
  misc_feature 1..21: note = n-mer motif encoding polynucleotide
  source 1..21: mol_type = other DNA
catgctaattatgttgaggtg

SEQ ID NO: 1222 - DNA, 21 bp, synthetic construct
  misc_feature 1..21: note = n-mer motif encoding polynucleotide
  source 1..21: mol_type = other DNA
acaacgaaaccggtcgcggaa

SEQ ID NO: 1223 - DNA, 21 bp, synthetic construct
  misc_feature 1..21: note = n-mer motif encoding polynucleotide
  source 1..21: mol_type = other DNA
tcgaccgccgttactaactca

SEQ ID NO: 1224 - DNA, 21 bp, synthetic construct
  misc_feature 1..21: note = n-mer motif encoding polynucleotide
  source 1..21: mol_type = other DNA
ctggggcttgctggtcaggtt

SEQ ID NO: 1225 - DNA, 21 bp, synthetic construct
  misc_feature 1..21: note = n-mer motif encoding polynucleotide
  source 1..21: mol_type = other DNA
gtgcttaagggtacgtttccg

SEQ ID NO: 1226 - DNA, 21 bp, synthetic construct
  misc_feature 1..21: note = n-mer motif encoding polynucleotide
  source 1..21: mol_type = other DNA
atgaatgagcctggtaggacg

SEQ ID NO: 1227 - DNA, 21 bp, synthetic construct
  misc_feature 1..21: note = n-mer motif encoding polynucleotide
  source 1..21: mol_type = other DNA
acttctgatcctttgaggaat

SEQ ID NO: 1228 - DNA, 21 bp, synthetic construct
  misc_feature 1..21: note = n-mer motif encoding polynucleotide
  source 1..21: mol_type = other DNA
cgtgatactaatacggataag

SEQ ID NO: 1229 - DNA, 21 bp, synthetic construct
  misc_feature 1..21: note = n-mer motif encoding polynucleotide
  source 1..21: mol_type = other DNA
gagtctgatttgcgtcagcgg

SEQ ID NO: 1230 - DNA, 21 bp, synthetic construct
  misc_feature 1..21: note = n-mer motif encoding polynucleotide
  source 1..21: mol_type = other DNA
tccggaatggccggcctttcc

SEQ ID NO: 1231 - DNA, 21 bp, synthetic construct
  misc_feature 1..21: note = n-mer motif encoding polynucleotide
  source 1..21: mol_type = other DNA
atagcaacaacgtctgggcgg

SEQ ID NO: 1232 - DNA, 21 bp, synthetic construct
  misc_feature 1..21: note = n-mer motif encoding polynucleotide
  source 1..21: mol_type = other DNA
acgattaggagtgagggtttt

SEQ ID NO: 1233 - DNA, 21 bp, synthetic construct
  misc_feature 1..21: note = n-mer motif encoding polynucleotide
  source 1..21: mol_type = other DNA
ggtctgtctattactattgcg

SEQ ID NO: 1234 - DNA, 21 bp, synthetic construct
  misc_feature 1..21: note = n-mer motif encoding polynucleotide
  source 1..21: mol_type = other DNA
ccgcctactaatgggcgtatg

SEQ ID NO: 1235 - DNA, 21 bp, synthetic construct
  misc_feature 1..21: note = n-mer motif encoding polynucleotide
  source 1..21: mol_type = other DNA
ctacaagaccgggcaacgaac

SEQ ID NO: 1236 - DNA, 21 bp, synthetic construct
  misc_feature 1..21: note = n-mer motif encoding polynucleotide
  source 1..21: mol_type = other DNA
cttaaatcgaccggtgaccac

SEQ ID NO: 1237 - DNA, 21 bp, synthetic construct
  misc_feature 1..21: note = n-mer motif encoding polynucleotide
  source 1..21: mol_type = other DNA
gataataataatcaggtttat

SEQ ID NO: 1238 - DNA, 21 bp, synthetic construct
  misc_feature 1..21: note = n-mer motif encoding polynucleotide
  source 1..21: mol_type = other DNA
gtgcatatggagtcgtatgcg

SEQ ID NO: 1239 - DNA, 21 bp, synthetic construct
  misc_feature 1..21: note = n-mer motif encoding polynucleotide
  source 1..21: mol_type = other DNA
gaccaaatagggcacggaaca

SEQ ID NO: 1240 - DNA, 21 bp, synthetic construct
  misc_feature 1..21: note = n-mer motif encoding polynucleotide
  source 1..21: mol_type = other DNA
gggacggggccgcatggtact

SEQ ID NO: 1241 - DNA, 21 bp, synthetic construct
  misc_feature 1..21: note = n-mer motif encoding polynucleotide
  source 1..21: mol_type = other DNA
attgggaataatactggtctt

SEQ ID NO: 1242 - DNA, 21 bp, synthetic construct
  misc_feature 1..21: note = n-mer motif encoding polynucleotide
  source 1..21: mol_type = other DNA
ttaaacgcagaatacaccaac

SEQ ID NO: 1243 - DNA, 21 bp, synthetic construct
  misc_feature 1..21: note = n-mer motif encoding polynucleotide
  source 1..21: mol_type = other DNA
gtgacgtcgtctgctagtggt

SEQ ID NO: 1244 - DNA, 21 bp, synthetic construct
  misc_feature 1..21: note = n-mer motif encoding polynucleotide
  source 1..21: mol_type = other DNA
acgcatgttgctaagcctgat

SEQ ID NO: 1245 - DNA, 21 bp, synthetic construct
  misc_feature 1..21: note = n-mer motif encoding polynucleotide
  source 1..21: mol_type = other DNA
ccgatgaacaaagacatactg

SEQ ID NO: 1246 - DNA, 21 bp, synthetic construct
  misc_feature 1..21: note = n-mer motif encoding polynucleotide
  source 1..21: mol_type = other DNA
cttagtttgaatatgaatgag

SEQ ID NO: 1247 - DNA, 21 bp, synthetic construct
  misc_feature 1..21: note = n-mer motif encoding polynucleotide
  source 1..21: mol_type = other DNA
gtcggcaactcaagcactcac

SEQ ID NO: 1248 - DNA, 21 bp, synthetic construct
  misc_feature 1..21: note = n-mer motif encoding polynucleotide
  source 1..21: mol_type = other DNA
ggccacggaagtgacttgacc

SEQ ID NO: 1249 - DNA, 21 bp, synthetic construct
  misc_feature 1..21: note = n-mer motif encoding polynucleotide
  source 1..21: mol_type = other DNA
cttacacaaaacccaacgaac

SEQ ID NO: 1250 - DNA, 21 bp, synthetic construct
  misc_feature 1..21: note = n-mer motif encoding polynucleotide
  source 1..21: mol_type = other DNA
ccgagtgatcatatgcggact

SEQ ID NO: 1251 - DNA, 21 bp, synthetic construct
  misc_feature 1..21: note = n-mer motif encoding polynucleotide
  source 1..21: mol_type = other DNA
cctgatagtcgtttggcggct

SEQ ID NO: 1252 - DNA, 21 bp, synthetic construct
  misc_feature 1..21: note = n-mer motif encoding polynucleotide
  source 1..21: mol_type = other DNA
tggggtagtgaggggacgatt

SEQ ID NO: 1253 - DNA, 21 bp, synthetic construct
  misc_feature 1..21: note = n-mer motif encoding polynucleotide
  source 1..21: mol_type = other DNA
aaaccgacaaacgactcgtac

SEQ ID NO: 1254 - DNA, 21 bp, synthetic construct
  misc_feature 1..21: note = n-mer motif encoding polynucleotide
  source 1..21: mol_type = other DNA
aaccgcggaacagaagtttac

SEQ ID NO: 1255 - DNA, 21 bp, synthetic construct
  misc_feature 1..21: note = n-mer motif encoding polynucleotide
  source 1..21: mol_type = other DNA
cacgtgatcacaacaaaagac

SEQ ID NO: 1256 - DNA, 21 bp, synthetic construct
  misc_feature 1..21: note = n-mer motif encoding polynucleotide
  source 1..21: mol_type = other DNA
attgtgtctaatccgccggcg

SEQ ID NO: 1257 - DNA, 21 bp, synthetic construct
  misc_feature 1..21: note = n-mer motif encoding polynucleotide
  source 1..21: mol_type = other DNA
atgcgtaacgaccaacaactt

SEQ ID NO: 1258 - DNA, 21 bp, synthetic construct
  misc_feature 1..21: note = n-mer motif encoding polynucleotide
  source 1..21: mol_type = other DNA
tttcagcgtgatgttggtcat

SEQ ID NO: 1259 - DNA, 21 bp, synthetic construct
  misc_feature 1..21: note = n-mer motif encoding polynucleotide
  source 1..21: mol_type = other DNA
gccaacgacaacaccaaacaa

SEQ ID NO: 1260 - DNA, 21 bp, synthetic construct
  misc_feature 1..21: note = n-mer motif encoding polynucleotide
  source 1..21: mol_type = other DNA
tctgttccgcatgcgggggat

SEQ ID NO: 1261 - DNA, 21 bp, synthetic construct
  misc_feature 1..21: note = n-mer motif encoding polynucleotide
  source 1..21: mol_type = other DNA
aatgctactccgccgaatcat

SEQ ID NO: 1262 - DNA, 21 bp, synthetic construct
  misc_feature 1..21: note = n-mer motif encoding polynucleotide
  source 1..21: mol_type = other DNA
tcagaacacacatcagttcta

SEQ ID NO: 1263 - DNA, 21 bp, synthetic construct
  misc_feature 1..21: note = n-mer motif encoding polynucleotide
  source 1..21: mol_type = other DNA
gccatgtcccaaacggacatc

SEQ ID NO: 1264 - DNA, 21 bp, synthetic construct
  misc_feature 1..21: note = n-mer motif encoding polynucleotide
  source 1..21: mol_type = other DNA
cctaaggctccgcttaataat

SEQ ID NO: 1265 - DNA, 21 bp, synthetic construct
  misc_feature 1..21: note = n-mer motif encoding polynucleotide
  source 1..21: mol_type = other DNA
accaacaacttactcgcacaa

SEQ ID NO: 1266 - DNA, 21 bp, synthetic construct
  misc_feature 1..21: note = n-mer motif encoding polynucleotide
  source 1..21: mol_type = other DNA
cagcgtcagggttcgggggtt

SEQ ID NO: 1267 - DNA, 21 bp, synthetic construct
  misc_feature 1..21: note = n-mer motif encoding polynucleotide
  source 1..21: mol_type = other DNA
cgcagtgacaccactaacgcc

SEQ ID NO: 1268 - DNA, 21 bp, synthetic construct
  misc_feature 1..21: note = n-mer motif encoding polynucleotide
  source 1..21: mol_type = other DNA
gaggctgataagaatggtgtt

SEQ ID NO: 1269 - DNA, 21 bp, synthetic construct
  misc_feature 1..21: note = n-mer motif encoding polynucleotide
  source 1..21: mol_type = other DNA
atgctggggggttttgcgcag

SEQ ID NO: 1270 - DNA, 21 bp, synthetic construct
  misc_feature 1..21: note = n-mer motif encoding polynucleotide
  source 1..21: mol_type = other DNA
atgacacacctcagcacagac

SEQ ID NO: 1271 - DNA, 21 bp, synthetic construct
  misc_feature 1..21: note = n-mer motif encoding polynucleotide
  source 1..21: mol_type = other DNA
gttttgtctgataaggcgttt

SEQ ID NO: 1272 - DNA, 21 bp, synthetic construct
  misc_feature 1..21: note = n-mer motif encoding polynucleotide
  source 1..21: mol_type = other DNA
acaccctccggtaccataaaa

SEQ ID NO: 1273 - DNA, 21 bp, synthetic construct
  misc_feature 1..21: note = n-mer motif encoding polynucleotide
  source 1..21: mol_type = other DNA
attattcttatgggtcagagt

SEQ ID NO: 1274 - DNA, 21 bp, synthetic construct
  misc_feature 1..21: note = n-mer motif encoding polynucleotide
  source 1..21: mol_type = other DNA
ctttcggggggtgagactctt

SEQ ID NO: 1275 - DNA, 21 bp, synthetic construct
  misc_feature 1..21: note = n-mer motif encoding polynucleotide
  source 1..21: mol_type = other DNA
accgacggcgccctgggttac

SEQ ID NO: 1276 - DNA, 21 bp, synthetic construct
  misc_feature 1..21: note = n-mer motif encoding polynucleotide
  source 1..21: mol_type = other DNA
gggaataaggctgcgctgacg

SEQ ID NO: 1277 - protein, 7 aa, synthetic construct
  REGION 1..7: note = n-mer motif
RGDLSTP

SEQ ID NO: 1278 - protein, 7 aa, synthetic construct
  REGION 1..7: note = n-mer motif
RGDLNQY

SEQ ID NO: 1279 - protein, 7 aa, synthetic construct
  REGION 1..7: note = n-mer motif
RGDLTTP

SEQ ID NO: 1280 - protein, 7 aa, synthetic construct
  REGION 1..7: note = n-mer motif
RGDATEL

SEQ ID NO: 1281 - protein, 7 aa, synthetic construct
  REGION 1..7: note = n-mer motif
RGDQLYH

SEQ ID NO: 1282 - protein, 7 aa, synthetic construct
  REGION 1..7: note = n-mer motif
RGDLSTP

SEQ ID NO: 1283 - protein, 7 aa, synthetic construct
  REGION 1..7: note = n-mer motif
RGDVAAK

SEQ ID NO: 1284 - protein, 7 aa, synthetic construct
  REGION 1..7: note = n-mer motif
RGDLTTP

SEQ ID NO: 1285 - protein, 7 aa, synthetic construct
  REGION 1..7: note = n-mer motif
RGDLNQY

SEQ ID NO: 1286 - protein, 7 aa, synthetic construct
  REGION 1..7: note = n-mer motif
RGDTMSK

SEQ ID NO: 1287 - protein, 7 aa, synthetic construct
  REGION 1..7: note = n-mer motif
RGDVAAK

SEQ ID NO: 1288 - protein, 7 aa, synthetic construct
  REGION 1..7: note = n-mer motif
RGDTMSK

SEQ ID NO: 1289 - protein, 7 aa, synthetic construct
  REGION 1..7: note = n-mer motif
RGDATEL

SEQ ID NO: 1290 - protein, 7 aa, synthetic construct
  REGION 1..7: note = n-mer motif
ARSNDSV

SEQ ID NO: 1291 - protein, 7 aa, synthetic construct
  REGION 1..7: note = n-mer motif
RGDMNNS

SEQ ID NO: 1292 - protein, 7 aa, synthetic construct
  REGION 1..7: note = n-mer motif
TMGANGT

SEQ ID NO: 1293 - protein, 7 aa, synthetic construct
  REGION 1..7: note = n-mer motif
PNVTQSY

SEQ ID NO: 1294 - protein, 7 aa, synthetic construct
  REGION 1..7: note = n-mer motif
RLDLQVH

SEQ ID NO: 1295 - protein, 7 aa, synthetic construct
  REGION 1..7: note = n-mer motif
GLSKASD

SEQ ID NO: 1296 - protein, 7 aa, synthetic construct
  REGION 1..7: note = n-mer motif
DPGRTGT

SEQ ID NO: 1297 - protein, 7 aa, synthetic construct
  REGION 1..7: note = n-mer motif
YRGREDW

SEQ ID NO: 1298 - protein, 7 aa, synthetic construct
  REGION 1..7: note = n-mer motif
RYGESIE

SEQ ID NO: 1299 - protein, 7 aa, synthetic construct
  REGION 1..7: note = n-mer motif
SLNNMGS

SEQ ID NO: 1300 - protein, 7 aa, synthetic construct
  REGION 1..7: note = n-mer motif
NSDQRNW

SEQ ID NO: 1301 - protein, 7 aa, synthetic construct
  REGION 1..7: note = n-mer motif
RGDMSRE

SEQ ID NO: 1302 - protein, 7 aa, synthetic construct
  REGION 1..7: note = n-mer motif
MTDANRI

SEQ ID NO: 1303 - protein, 7 aa, synthetic construct
  REGION 1..7: note = n-mer motif
VYNGNVV

SEQ ID NO: 1304 - protein, 7 aa, synthetic construct
  REGION 1..7: note = n-mer motif
RGDMINT

SEQ ID NO: 1305 - protein, 7 aa, synthetic construct
  REGION 1..7: note = n-mer motif
SGLSHGQ

SEQ ID NO: 1306 - protein, 7 aa, synthetic construct
  REGION 1..7: note = n-mer motif
TGQLVGT

SEQ ID NO: 1307 - protein, 7 aa, synthetic construct
  REGION 1..7: note = n-mer motif
ANSIGGP

SEQ ID NO: 1308 - protein, 7 aa, synthetic construct
  REGION 1..7: note = n-mer motif
YSQSLSE

SEQ ID NO: 1309 - protein, 7 aa, synthetic construct
  REGION 1..7: note = n-mer motif
YHKYSTD

SEQ ID NO: 1310 - protein, 7 aa, synthetic construct
  REGION 1..7: note = n-mer motif
ARHDEHV

SEQ ID NO: 1311 - protein, 7 aa, synthetic construct
  REGION 1..7: note = n-mer motif
AIDSIKQ

SEQ ID NO: 1312 - protein, 7 aa, synthetic construct
  REGION 1..7: note = n-mer motif
RLDLQVN

SEQ ID NO: 1313 - protein, 7 aa, synthetic construct
  REGION 1..7: note = n-mer motif
RGDMINT

SEQ ID NO: 1314 - protein, 7 aa, synthetic construct
  REGION 1..7: note = n-mer motif
SVLSQAN

SEQ ID NO: 1315 - protein, 7 aa, synthetic construct
  REGION 1..7: note = n-mer motif
FTVNQDL

SEQ ID NO: 1316 - protein, 7 aa, synthetic construct
  REGION 1..7: note = n-mer motif
TDNGLLV

SEQ ID NO: 1317 - protein, 7 aa, synthetic construct
  REGION 1..7: note = n-mer motif
YQQTSST

SEQ ID NO: 1318 - protein, 7 aa, synthetic construct
  REGION 1..7: note = n-mer motif
TEQSYSR

SEQ ID NO: 1319 - protein, 7 aa, synthetic construct
  REGION 1..7: note = n-mer motif
IMGLSQA

SEQ ID NO: 1320 - protein, 7 aa, synthetic construct
  REGION 1..7: note = n-mer motif
ATAHQDG

SEQ ID NO: 1321 - protein, 7 aa, synthetic construct
  REGION 1..7: note = n-mer motif
YNATPSQ

SEQ ID NO: 1322 - protein, 7 aa, synthetic construct
  REGION 1..7: note = n-mer motif
YTQGIMN

SEQ ID NO: 1323 - protein, 7 aa, synthetic construct
  REGION 1..7: note = n-mer motif
ESLPISK

SEQ ID NO: 1324 - protein, 7 aa, synthetic construct
  REGION 1..7: note = n-mer motif
GTVVPGS

SEQ ID NO: 1325 - protein, 7 aa, synthetic construct
  REGION 1..7: note = n-mer motif
GLASLHL

SEQ ID NO: 1326 - protein, 7 aa, synthetic construct
  REGION 1..7: note = n-mer motif
YIAAGEQ

SEQ ID NO: 1327 - protein, 7 aa, synthetic construct
  REGION 1..7: note = n-mer motif
NTYPFNA

SEQ ID NO: 1328 - protein, 7 aa, synthetic construct
  REGION 1..7: note = n-mer motif
VGASTAS

SEQ ID NO: 1329 - protein, 7 aa, synthetic construct
  REGION 1..7: note = n-mer motif
GSNYLAN

SEQ ID NO: 1330 - protein, 7 aa, synthetic construct
  REGION 1..7: note = n-mer motif
DTGRTGT

SEQ ID NO: 1331 - protein, 7 aa, synthetic construct
  REGION 1..7: note = n-mer motif
KPNTMSD

SEQ ID NO: 1332 - protein, 7 aa, synthetic construct
  REGION 1..7: note = n-mer motif
VDKSSPV

SEQ ID NO: 1333 - protein, 7 aa, synthetic construct
  REGION 1..7: note = n-mer motif
SSDPKGQ

SEQ ID NO: 1334 - protein, 7 aa, synthetic construct
  REGION 1..7: note = n-mer motif
WQTNGMQ

SEQ ID NO: 1335 - protein, 7 aa, synthetic construct
  REGION 1..7: note = n-mer motif
TGSLNSM

SEQ ID NO: 1336 - protein, 7 aa, synthetic construct
  REGION 1..7: note = n-mer motif
HSNSSQN

SEQ ID NO: 1337 - protein, 7 aa, synthetic construct
  REGION 1..7: note = n-mer motif
GRDDLTN

SEQ ID NO: 1338 - protein, 7 aa, synthetic construct
  REGION 1..7: note = n-mer motif
DTYKGKW

SEQ ID NO: 1339 - protein, 7 aa, synthetic construct
  REGION 1..7: note = n-mer motif
YTAQTGW

SEQ ID NO: 1340 - protein, 7 aa, synthetic construct
  REGION 1..7: note = n-mer motif
NQVGASA

SEQ ID NO: 1341 - protein, 7 aa, synthetic construct
  REGION 1..7: note = n-mer motif
IDVLNGS

SEQ ID NO: 1342 - protein, 7 aa, synthetic construct
  REGION 1..7: note = n-mer motif
FRTVYTG

SEQ ID NO: 1343 - protein, 7 aa, synthetic construct
  REGION 1..7: note = n-mer motif
GNMVTPN

SEQ ID NO: 1344 - protein, 7 aa, synthetic construct
  REGION 1..7: note = n-mer motif
DTYNGKW

SEQ ID NO: 1345 - protein, 7 aa, synthetic construct
  REGION 1..7: note = n-mer motif
TIQDHIK

SEQ ID NO: 1346 - protein, 7 aa, synthetic construct
  REGION 1..7: note = n-mer motif
GAKGTMG

SEQ ID NO: 1347 - protein, 7 aa, synthetic construct
  REGION 1..7: note = n-mer motif
TRSNSDE

SEQ ID NO: 1348 - protein, 7 aa, synthetic construct
  REGION 1..7: note = n-mer motif
ATTLTGD

SEQ ID NO: 1349 - protein, 7 aa, synthetic construct
  REGION 1..7: note = n-mer motif
SYGGSGP

SEQ ID NO: 1350 - protein, 7 aa, synthetic construct
  REGION 1..7: note = n-mer motif
EKSVESK

SEQ ID NO: 1351 - protein, 7 aa, synthetic construct
  REGION 1..7: note = n-mer motif
RGDTMNY

SEQ ID NO: 1352 - protein, 7 aa, synthetic construct
  REGION 1..7: note = n-mer motif
RDLGQTG

SEQ ID NO: 1353 - protein, 7 aa, synthetic construct
  REGION 1..7: note = n-mer motif
SPQLSVM

SEQ ID NO: 1354 - protein, 7 aa, synthetic construct
  REGION 1..7: note = n-mer motif
RGDNSTP

SEQ ID NO: 1355 - protein, 7 aa, synthetic construct
  REGION 1..7: note = n-mer motif
PMAGHPP

SEQ ID NO: 1356 - protein, 7 aa, synthetic construct
  REGION 1..7: note = n-mer motif
TAYQAGL

SEQ ID NO: 1357 - protein, 7 aa, synthetic construct
  REGION 1..7: note = n-mer motif
VVNQGNQ

SEQ ID NO: 1358 - protein, 7 aa, synthetic construct
  REGION 1..7: note = n-mer motif
DKTEMLQ

SEQ ID NO: 1359 - protein, 7 aa, synthetic construct
  REGION 1..7: note = n-mer motif
TVMMSTR

SEQ ID NO: 1360 - protein, 7 aa, synthetic construct
  REGION 1..7: note = n-mer motif
QQNTRLP

SEQ ID NO: 1361 - protein, 7 aa, synthetic construct
  REGION 1..7: note = n-mer motif
YQHNQAH

SEQ ID NO: 1362 - protein, 7 aa, synthetic construct
  REGION 1..7: note = n-mer motif
NQSINNI

SEQ ID NO: 1363 - protein, 7 aa, synthetic construct
  REGION 1..7: note = n-mer motif
RGDHSTP

SEQ ID NO: 1364 - protein, 7 aa, synthetic construct
  REGION 1..7: note = n-mer motif
DSTLHLS

SEQ ID NO: 1365 - protein, 7 aa, synthetic construct
  REGION 1..7: note = n-mer motif
ANIENTS

SEQ ID NO: 1366 - protein, 7 aa, synthetic construct
  REGION 1..7: note = n-mer motif
TNAALVP

SEQ ID NO: 1367 - protein, 7 aa, synthetic construct
  REGION 1..7: note = n-mer motif
GQKETTA

SEQ ID NO: 1368 - protein, 7 aa, synthetic construct
  REGION 1..7: note = n-mer motif
ELNTAHA

SEQ ID NO: 1369 - protein, 7 aa, synthetic construct
  REGION 1..7: note = n-mer motif
GVSSNSA

SEQ ID NO: 1370 - protein, 7 aa, synthetic construct
  REGION 1..7: note = n-mer motif
STNAGQR

SEQ ID NO: 1371 - protein, 7 aa, synthetic construct
  REGION 1..7: note = n-mer motif
EQQKTDN

SEQ ID NO: 1372 - protein, 7 aa, synthetic construct
  REGION 1..7: note = n-mer motif
AVVNENM

SEQ ID NO: 1373 - protein, 7 aa, synthetic construct
  REGION 1..7: note = n-mer motif
GSVSTSA

SEQ ID NO: 1374 - protein, 7 aa, synthetic construct
  REGION 1..7: note = n-mer motif
ELGSQRM

SEQ ID NO: 1375 - protein, 7 aa, synthetic construct
  REGION 1..7: note = n-mer motif
RGDLSTH

SEQ ID NO: 1376 - protein, 7 aa, synthetic construct
  REGION 1..7: note = n-mer motif
DHQQALA

SEQ ID NO: 1377 - protein, 7 aa, synthetic construct
  REGION 1..7: note = n-mer motif
NRSDAHE

SEQ ID NO: 1378 - protein, 7 aa, synthetic construct
  REGION 1..7: note = n-mer motif
NVNAQSR

SEQ ID NO: 1379 - protein, 7 aa, synthetic construct
  REGION 1..7: note = n-mer motif
TQGNNMV

SEQ ID NO: 1380 - protein, 7 aa, synthetic construct
  REGION 1..7: note = n-mer motif
TALNTYP

SEQ ID NO: 1381 - protein, 7 aa, synthetic construct
  REGION 1..7: note = n-mer motif
VSTYLLA

SEQ ID NO: 1382 - protein, 7 aa, synthetic construct
  REGION 1..7: note = n-mer motif
GGNYNTT

SEQ ID NO: 1383 - protein, 7 aa, synthetic construct
  REGION 1..7: note = n-mer motif
SNIKPEI

SEQ ID NO: 1384 - protein, 7 aa, synthetic construct
  REGION 1..7: note = n-mer motif
PRVHGQV

SEQ ID NO: 1385 - protein, 7 aa, synthetic construct
  REGION 1..7: note = n-mer motif
SNSNTAA

SEQ ID NO: 1386 - protein, 7 aa, synthetic construct
  REGION 1..7: note = n-mer motif
LEVATSP

SEQ ID NO: 1387 - protein, 7 aa, synthetic construct
  REGION 1..7: note = n-mer motif
HDADKLA

SEQ ID NO: 1388 - protein, 7 aa, synthetic construct
  REGION 1..7: note = n-mer motif
GVYIDGR

SEQ ID NO: 1389 - protein, 7 aa, synthetic construct
  REGION 1..7: note = n-mer motif
SMQSYTM

SEQ ID NO: 1390 - protein, 7 aa, synthetic construct
  REGION 1..7: note = n-mer motif
SKGNEQM

SEQ ID NO: 1391 - protein, 7 aa, synthetic construct
  REGION 1..7: note = n-mer motif
GRDYAMS

SEQ ID NO: 1392 - protein, 7 aa, synthetic construct
  REGION 1..7: note = n-mer motif
TDGIFQP

SEQ ID NO: 1393 - protein, 7 aa, synthetic construct
  REGION 1..7: note = n-mer motif
GSPVIVN

SEQ ID NO: 1394 - protein, 7 aa, synthetic construct
  REGION 1..7: note = n-mer motif
TLTDVHR

SEQ ID NO: 1395 - protein, 7 aa, synthetic construct
  REGION 1..7: note = n-mer motif
KSEVPAR

SEQ ID NO: 1396 - protein, 7 aa, synthetic construct
  REGION 1..7: note = n-mer motif
VNTGALL

SEQ ID NO: 1397 - protein, 7 aa, synthetic construct
  REGION 1..7: note = n-mer motif
SQQGFTL

SEQ ID NO: 1398 - protein, 7 aa, synthetic construct
  REGION 1..7: note = n-mer motif
NNKSVPD

SEQ ID NO: 1399 - protein, 7 aa, synthetic construct
  REGION 1..7: note = n-mer motif
SVMVGTN

SEQ ID NO: 1400 - protein, 7 aa, synthetic construct
  REGION 1..7: note = n-mer motif
RNENTYN

SEQ ID NO: 1401 - protein, 7 aa, synthetic construct
  REGION 1..7: note = n-mer motif
QANLSII

SEQ ID NO: 1402 - protein, 7 aa, synthetic construct
  REGION 1..7: note = n-mer motif
PGRDSRT

SEQ ID NO: 1403 - protein, 7 aa, synthetic construct
  REGION 1..7: note = n-mer motif
FPANGGA

SEQ ID NO: 1404 - protein, 7 aa, synthetic construct
  REGION 1..7: note = n-mer motif
AGKDLSN

SEQ ID NO: 1405 - protein, 7 aa, synthetic construct
  REGION 1..7: note = n-mer motif
AQFESGR

SEQ ID NO: 1406 - protein, 7 aa, synthetic construct
  REGION 1..7: note = n-mer motif
GYGSYSN

SEQ ID NO: 1407 - protein, 7 aa, synthetic construct
  REGION 1..7: note = n-mer motif
TIVSAYA

SEQ ID NO: 1408 - protein, 7 aa, synthetic construct
  REGION 1..7: note = n-mer motif
NVSPNLT

SEQ ID NO: 1409 - protein, 7 aa, synthetic construct
  REGION 1..7: note = n-mer motif
RGDLSTP

SEQ ID NO: 1410 - protein, 7 aa, synthetic construct
  REGION 1..7: note = n-mer motif
FLEGVAQ

SEQ ID NO: 1411 - protein, 7 aa, synthetic construct
  REGION 1..7: note = n-mer motif
GSERGER

SEQ ID NO: 1412 - protein, 7 aa, synthetic construct
  REGION 1..7: note = n-mer motif
LNVGSSL

SEQ ID NO: 1413 - protein, 7 aa, synthetic construct
  REGION 1..7: note = n-mer motif
RIVANEQ

SEQ ID NO: 1414 - protein, 7 aa, synthetic construct
  REGION 1..7: note = n-mer motif
QSIGHPV

SEQ ID NO: 1415 - protein, 7 aa, synthetic construct
  REGION 1..7: note = n-mer motif
GGMSAHS

SEQ ID NO: 1416 - protein, 7 aa, synthetic construct
  REGION 1..7: note = n-mer motif
HSTTSMT

SEQ ID NO: 1417 - protein, 7 aa, synthetic construct
  REGION 1..7: note = n-mer motif
TVNGTNV

SEQ ID NO: 1418 - protein, 7 aa, synthetic construct
  REGION 1..7: note = n-mer motif
LAPDNIG

SEQ ID NO: 1419 - protein, 7 aa, synthetic construct
  REGION 1..7: note = n-mer motif
QTATLVA

SEQ ID NO: 1420 - protein, 7 aa, synthetic construct
  REGION 1..7: note = n-mer motif
ASAPSEF

SEQ ID NO: 1421 - protein, 7 aa, synthetic construct
  REGION 1..7: note = n-mer motif
SMEGQQH

SEQ ID NO: 1422 - protein, 7 aa, synthetic construct
  REGION 1..7: note = n-mer motif
QDVGRTN

SEQ ID NO: 1423 - protein, 7 aa, synthetic construct
  REGION 1..7: note = n-mer motif
VYNGNEV

SEQ ID NO: 1424 - protein, 7 aa, synthetic construct
  REGION 1..7: note = n-mer motif
AQAQTGW

SEQ ID NO: 1425 - protein, 7 aa, synthetic construct
  REGION 1..7: note = n-mer motif
RLDLTHT

SEQ ID NO: 1426 - protein, 7 aa, synthetic construct
  REGION 1..7: note = n-mer motif
AAHGREQ

SEQ ID NO: 1427 - protein, 7 aa, synthetic construct
  REGION 1..7: note = n-mer motif
RGDLYTP

SEQ ID NO: 1428 - protein, 7 aa, synthetic construct
  REGION 1..7: note = n-mer motif
GMQQREK

SEQ ID NO: 1429 - protein, 7 aa, synthetic construct
  REGION 1..7: note = n-mer motif
QTQASTN

SEQ ID NO: 1430 - protein, 7 aa, synthetic construct
  REGION 1..7: note = n-mer motif
RDTNALG

SEQ ID NO: 1431 - protein, 7 aa, synthetic construct
  REGION 1..7: note = n-mer motif
SSQISNS

SEQ ID NO: 1432 - protein, 7 aa, synthetic construct
  REGION 1..7: note = n-mer motif
QSVNSTS

SEQ ID NO: 1433 - protein, 7 aa, synthetic construct
  REGION 1..7: note = n-mer motif
ALERAQY

SEQ ID NO: 1434 - protein, 7 aa, synthetic construct
  REGION 1..7: note = n-mer motif
HTGHSSV

SEQ ID NO: 1435 - protein, 7 aa, synthetic construct
  REGION 1..7: note = n-mer motif
RGDMTRA

SEQ ID NO: 1436 - protein, 7 aa, synthetic construct
  REGION 1..7: note = n-mer motif
FQRDLGH

SEQ ID NO: 1437 - protein, 7 aa, synthetic construct
  REGION 1..7: note = n-mer motif
TTGDIIR

SEQ ID NO: 1438 - protein, 7 aa, synthetic construct
  REGION 1..7: note = n-mer motif
SFQTDRA

SEQ ID NO: 1439 - protein, 7 aa, synthetic construct
  REGION 1..7: note = n-mer motif
QSSDGRV

SEQ ID NO: 1440 - protein, 7 aa, synthetic construct
  REGION 1..7: note = n-mer motif
TSGALTR

SEQ ID NO: 1441 - protein, 7 aa, synthetic construct
  REGION 1..7: note = n-mer motif
NSNTVNT

SEQ ID NO: 1442 - protein, 7 aa, synthetic construct
  REGION 1..7: note = n-mer motif
ISGSSSL

SEQ ID NO: 1443 - protein, 7 aa, synthetic construct
  REGION 1..7: note = n-mer motif
NDKSTNV

SEQ ID NO: 1444 - protein, 7 aa, synthetic construct
  REGION 1..7: note = n-mer motif
IVLAPTS

SEQ ID NO: 1445 - protein, 7 aa, synthetic construct
  REGION 1..7: note = n-mer motif
SGVNYGV

SEQ ID NO: 1446 - protein, 7 aa, synthetic construct
  REGION 1..7: note = n-mer motif
VGAQRDP

SEQ ID NO: 1447 - protein, 7 aa, synthetic construct
  REGION 1..7: note = n-mer motif
TGMNSNK

SEQ ID NO: 1448 - protein, 7 aa, synthetic construct
  REGION 1..7: note = n-mer motif
IEAYSRD

SEQ ID NO: 1449 - protein, 7 aa, synthetic construct
  REGION 1..7: note = n-mer motif
LHTTLMP

SEQ ID NO: 1450 - protein, 7 aa, synthetic construct
  REGION 1..7: note = n-mer motif
SDNHLKT

SEQ ID NO: 1451 - protein, 7 aa, synthetic construct
  REGION 1..7: note = n-mer motif
RNEDKGG

SEQ ID NO: 1452 - protein, 7 aa, synthetic construct
  REGION 1..7: note = n-mer motif
TKGANGT

SEQ ID NO: 1453 - protein, 7 aa, synthetic construct
  REGION 1..7: note = n-mer motif
VYNGNVE

SEQ ID NO: 1454 - protein, 7 aa, synthetic construct
  REGION 1..7: note = n-mer motif
SNSGGNH

SEQ ID NO: 1455 - protein, 7 aa, synthetic construct
  REGION 1..7: note = n-mer motif
VAAGPEA

SEQ ID NO: 1456 - protein, 7 aa, synthetic construct
  REGION 1..7: note = n-mer motif
TSLSGSA

SEQ ID NO: 1457 - protein, 7 aa, synthetic construct
  REGION 1..7: note = n-mer motif
VGLQSNT

SEQ ID NO: 1458 - protein, 7 aa, synthetic construct
  REGION 1..7: note = n-mer motif
HTAHSVD

SEQ ID NO: 1459 - protein, 7 aa, synthetic construct
  REGION 1..7: note = n-mer motif
NVGMSST

SEQ ID NO: 1460 - protein, 7 aa, synthetic construct
  REGION 1..7: note = n-mer motif
HADVNAG

SEQ ID NO: 1461 - protein, 7 aa, synthetic construct
  REGION 1..7: note = n-mer motif
KAGQLVE

SEQ ID NO: 1462 - protein, 7 aa, synthetic construct
  REGION 1..7: note = n-mer motif
STFSVLP

SEQ ID NO: 1463 - protein, 7 aa, synthetic construct
  REGION 1..7: note = n-mer motif
PQSPSRV

SEQ ID NO: 1464 - protein, 7 aa, synthetic construct
  REGION 1..7: note = n-mer motif
HTATLSS

SEQ ID NO: 1465 - protein, 7 aa, synthetic construct
  REGION 1..7: note = n-mer motif
LPRHDQY

SEQ ID NO: 1466 - protein, 7 aa, synthetic construct
  REGION 1..7: note = n-mer motif
QVNNPLT

SEQ ID NO: 1467 - protein, 7 aa, synthetic construct
  REGION 1..7: note = n-mer motif
TTETARG

SEQ ID NO: 1468 - protein, 7 aa, synthetic construct
  REGION 1..7: note = n-mer motif
VHGTLTY

SEQ ID NO: 1469 - protein, 7 aa, synthetic construct
  REGION 1..7: note = n-mer motif
YSTDLRM

SEQ ID NO: 1470 - protein, 7 aa, synthetic construct
  REGION 1..7: note = n-mer motif
AHATSST

SEQ ID NO: 1471 - protein, 7 aa, synthetic construct
  REGION 1..7: note = n-mer motif
RESAALA

SEQ ID NO: 1472 - protein, 7 aa, synthetic construct
  REGION 1..7: note = n-mer motif
KDTNQQI

SEQ ID NO: 1473 - protein, 7 aa, synthetic construct
  REGION 1..7: note = n-mer motif
SMQSYTM

SEQ ID NO: 1474 - protein, 7 aa, synthetic construct
  REGION 1..7: note = n-mer motif
TAYSPTV

SEQ ID NO: 1475 - protein, 7 aa, synthetic construct
  REGION 1..7: note = n-mer motif
ESAHQRI

SEQ ID NO: 1476 - protein, 7 aa, synthetic construct
  REGION 1..7: note = n-mer motif
RYTTAQQ

SEQ ID NO: 1477 - protein, 7 aa, synthetic construct
  REGION 1..7: note = n-mer motif
TSVANVS

SEQ ID NO: 1478 - protein, 7 aa, synthetic construct
  REGION 1..7: note = n-mer motif
RDQHTSI

SEQ ID NO: 1479 - protein, 7 aa, synthetic construct
  REGION 1..7: note = n-mer motif
SVTSSGP

SEQ ID NO: 1480 - protein, 7 aa, synthetic construct
  REGION 1..7: note = n-mer motif
AVVLNSN

SEQ ID NO: 1481 - protein, 7 aa, synthetic construct
  REGION 1..7: note = n-mer motif
PGNPSSN

SEQ ID NO: 1482 - protein, 7 aa, synthetic construct
  REGION 1..7: note = n-mer motif
TGSTTQL

SEQ ID NO: 1483 - protein, 7 aa, synthetic construct
  REGION 1..7: note = n-mer motif
ANEHNVG

SEQ ID NO: 1484 - protein, 7 aa, synthetic construct
  REGION 1..7: note = n-mer motif
MQREAAN

SEQ ID NO: 1485 - protein, 7 aa, synthetic construct
  REGION 1..7: note = n-mer motif
LTDTNTR

SEQ ID NO: 1486 - protein, 7 aa, synthetic construct
  REGION 1..7: note = n-mer motif
RMTEISY

SEQ ID NO: 1487 - protein, 7 aa, synthetic construct
  REGION 1..7: note = n-mer motif
KVDMTSK

SEQ ID NO: 1488 - protein, 7 aa, synthetic construct
  REGION 1..7: note = n-mer motif
RGDLSTP

SEQ ID NO: 1489 - protein, 7 aa, synthetic construct
  REGION 1..7: note = n-mer motif
QAKASTT

SEQ ID NO: 1490 - protein, 7 aa, synthetic construct
  REGION 1..7: note = n-mer motif
LPSTETL

SEQ ID NO: 1491 - protein, 7 aa, synthetic construct
  REGION 1..7: note = n-mer motif
SSALNAY

SEQ ID NO: 1492 - protein, 7 aa, synthetic construct
  REGION 1..7: note = n-mer motif
SSDPKGQ

SEQ ID NO: 1493 - protein, 7 aa, synthetic construct
  REGION 1..7: note = n-mer motif
LDVTRMR

SEQ ID NO: 1494 - protein, 7 aa, synthetic construct
  REGION 1..7: note = n-mer motif
ADGGDKG

SEQ ID NO: 1495 - protein, 7 aa, synthetic construct
  REGION 1..7: note = n-mer motif
MLSQVTL

SEQ ID NO: 1496 - protein, 7 aa, synthetic construct
  REGION 1..7: note = n-mer motif
SVSSVVL

SEQ ID NO: 1497 - protein, 7 aa, synthetic construct
  REGION 1..7: note = n-mer motif
TESQTMR

SEQ ID NO: 1498 - protein, 7 aa, synthetic construct
  REGION 1..7: note = n-mer motif
FGSQEKL

SEQ ID NO: 1499 - protein, 7 aa, synthetic construct
  REGION 1..7: note = n-mer motif
TAGGERA

SEQ ID NO: 1500 - protein, 7 aa, synthetic construct
  REGION 1..7: note = n-mer motif
DHSKQSS

SEQ ID NO: 1501 - protein, 7 aa, synthetic construct
  REGION 1..7: note = n-mer motif
IDSTWNT

SEQ ID NO: 1502 - protein, 7 aa, synthetic construct
  REGION 1..7: note = n-mer motif
SPRPELR

SEQ ID NO: 1503 - protein, 7 aa, synthetic construct
  REGION 1..7: note = n-mer motif
SIATATS

SEQ ID NO: 1504 - protein, 7 aa, synthetic construct
  REGION 1..7: note = n-mer motif
VIGGHGT

SEQ ID NO: 1505 - protein, 7 aa, synthetic construct
  REGION 1..7: note = n-mer motif
STAMYPH

SEQ ID NO: 1506 - protein, 7 aa, synthetic construct
  REGION 1..7: note = n-mer motif
RDLRPVT

SEQ ID NO: 1507 - protein, 7 aa, synthetic construct
  REGION 1..7: note = n-mer motif
AHLTDLP

SEQ ID NO: 1508 - protein, 7 aa, synthetic construct
  REGION 1..7: note = n-mer motif
FLNSTQL

SEQ ID NO: 1509 - protein, 7 aa, synthetic construct
  REGION 1..7: note = n-mer motif
LNNSATV

SEQ ID NO: 1510 - protein, 7 aa, synthetic construct
  REGION 1..7: note = n-mer motif
DRPNNMT

SEQ ID NO: 1511 - protein, 7 aa, synthetic construct
  REGION 1..7: note = n-mer motif
SSSDSPR

SEQ ID NO: 1512 - protein, 7 aa, synthetic construct
  REGION 1..7: note = n-mer motif
RLDVGSP

SEQ ID NO: 1513 - protein, 7 aa, synthetic construct
  REGION 1..7: note = n-mer motif
AQQSLHG

SEQ ID NO: 1514 - protein, 7 aa, synthetic construct
  REGION 1..7: note = n-mer motif
MGKHEGL

SEQ ID NO: 1515 - protein, 7 aa, synthetic construct
  REGION 1..7: note = n-mer motif
ENAREGV

SEQ ID NO: 1516 - protein, 7 aa, synthetic construct
  REGION 1..7: note = n-mer motif
TVSLSEG

SEQ ID NO: 1517 - protein, 7 aa, synthetic construct
  REGION 1..7: note = n-mer motif
LNTLIDR

SEQ ID NO: 1518 - protein, 7 aa, synthetic construct
  REGION 1..7: note = n-mer motif
ELSVPKP

SEQ ID NO: 1519 - protein, 7 aa, synthetic construct
  REGION 1..7: note = n-mer motif
KDKNVYI

SEQ ID NO: 1520 - protein, 7 aa, synthetic construct
  REGION 1..7: note = n-mer motif
NANGPVS

SEQ ID NO: 1521 - protein, 7 aa, synthetic construct
  REGION 1..7: note = n-mer motif
LTTNGML

SEQ ID NO: 1522 - protein, 7 aa, synthetic construct
  REGION 1..7: note = n-mer motif
AGESSPT

SEQ ID NO: 1523 - protein, 7 aa, synthetic construct
  REGION 1..7: note = n-mer motif
SGIGTYS

SEQ ID NO: 1524 - protein, 7 aa, synthetic construct
  REGION 1..7: note = n-mer motif
VRSMDEL

SEQ ID NO: 1525 - protein, 7 aa, synthetic construct
  REGION 1..7: note = n-mer motif
MNTGSSS

SEQ ID NO: 1526 - protein, 7 aa, synthetic construct
  REGION 1..7: note = n-mer motif
GVTVREL

SEQ ID NO: 1527 - protein, 7 aa, synthetic construct
  REGION 1..7: note = n-mer motif
QILNYSV

SEQ ID NO: 1528 - protein, 7 aa, synthetic construct
  REGION 1..7: note = n-mer motif
MAGEYRV

SEQ ID NO: 1529 - protein, 7 aa, synthetic construct
  REGION 1..7: note = n-mer motif
WSHDRPT

SEQ ID NO: 1530 - protein, 7 aa, synthetic construct
  REGION 1..7: note = n-mer motif
CKNNSEC

SEQ ID NO: 1531 - protein, 7 aa, synthetic construct
  REGION 1..7: note = n-mer motif
LTTNSHY

SEQ ID NO: 1532 - protein, 7 aa, synthetic construct
  REGION 1..7: note = n-mer motif
MLVQNTP

SEQ ID NO: 1533 - protein, 7 aa, synthetic construct
  REGION 1..7: note = n-mer motif
RGATEHA

SEQ ID NO: 1534 - protein, 7 aa, synthetic construct
  REGION 1..7: note = n-mer motif
ASNGSMG

SEQ ID NO: 1535 - protein, 7 aa, synthetic construct
  REGION 1..7: note = n-mer motif
NSYTAGK

SEQ ID NO: 1536 - protein, 7 aa, synthetic construct
  REGION 1..7: note = n-mer motif
STQGAIL

SEQ ID NO: 1537 - protein, 7 aa, synthetic construct
  REGION 1..7: note = n-mer motif
WNTNMAI

SEQ ID NO: 1538 - protein, 7 aa, synthetic construct
  REGION 1..7: note = n-mer motif
VSSYEKI

SEQ ID NO: 1539 - protein, 7 aa, synthetic construct
  REGION 1..7: note = n-mer motif
VLSTGQR

SEQ ID NO: 1540 - protein, 7 aa, synthetic construct
  REGION 1..7: note = n-mer motif
PIPHGSS

SEQ ID NO: 1541 - protein, 7 aa, synthetic construct
  REGION 1..7: note = n-mer motif
NVSLTQT

SEQ ID NO: 1542 - protein, 7 aa, synthetic construct
  REGION 1..7: note = n-mer motif
STIGNST

SEQ ID NO: 1543 - protein, 7 aa, synthetic construct
  REGION 1..7: note = n-mer motif
SEKLTDK

SEQ ID NO: 1544 - protein, 7 aa, synthetic construct
  REGION 1..7: note = n-mer motif
SKDSNIS

SEQ ID NO: 1545 - protein, 7 aa, synthetic construct
  REGION 1..7: note = n-mer motif
ANSNHER

SEQ ID NO: 1546 - protein, 7 aa, synthetic construct
  REGION 1..7: note = n-mer motif
RDTGDKA

SEQ ID NO: 1547 - protein, 7 aa, synthetic construct
  REGION 1..7: note = n-mer motif
RTDTPST

SEQ ID NO: 1548 - protein, 7 aa, synthetic construct
  REGION 1..7: note = n-mer motif
PTMSSLN

SEQ ID NO: 1549 - protein, 7 aa, synthetic construct
  REGION 1..7: note = n-mer motif
DITNQSY

SEQ ID NO: 1550 - protein, 7 aa, synthetic construct
  REGION 1..7: note = n-mer motif
LVKPETW

SEQ ID NO: 1551 - protein, 7 aa, synthetic construct
  REGION 1..7: note = n-mer motif
GTSLENR

SEQ ID NO: 1552 - protein, 7 aa, synthetic construct
  REGION 1..7: note = n-mer motif
AAGNPTR

SEQ ID NO: 1553 - protein, 7 aa, synthetic construct
  REGION 1..7: note = n-mer motif
HNVGLGH

SEQ ID NO: 1554 - protein, 7 aa, synthetic construct
  REGION 1..7: note = n-mer motif
VSTTTDR

SEQ ID NO: 1555 - protein, 7 aa, synthetic construct
  REGION 1..7: note = n-mer motif
YLSSGKM

SEQ ID NO: 1556 - protein, 7 aa, synthetic construct
  REGION 1..7: note = n-mer motif
DSRNAAL

SEQ ID NO: 1557 - protein, 7 aa, synthetic construct
  REGION 1..7: note = n-mer motif
VERNTDM

SEQ ID NO: 1558 - protein, 7 aa, synthetic construct
  REGION 1..7: note = n-mer motif
TVGSNSI

SEQ ID NO: 1559 - protein, 7 aa, synthetic construct
  REGION 1..7: note = n-mer motif
VRSGNKP

SEQ ID NO: 1560 - protein, 7 aa, synthetic construct
  REGION 1..7: note = n-mer motif
GSSGNSG

SEQ ID NO: 1561 - protein, 7 aa, synthetic construct
  REGION 1..7: note = n-mer motif
STSIGVV

SEQ ID NO: 1562 - protein, 7 aa, synthetic construct
  REGION 1..7: note = n-mer motif
PSQSRSL

SEQ ID NO: 1563 - protein, 7 aa, synthetic construct
  REGION 1..7: note = n-mer motif
RNENLNN

SEQ ID NO: 1564 - protein, 7 aa, synthetic construct
  REGION 1..7: note = n-mer motif
SLGKREE

SEQ ID NO: 1565 - protein, 7 aa, synthetic construct
  REGION 1..7: note = n-mer motif
SRLDSSS

SEQ ID NO: 1566 - protein, 7 aa, synthetic construct
  REGION 1..7: note = n-mer motif
DSTYVLA

SEQ ID NO: 1567 - protein, 7 aa, synthetic construct
  REGION 1..7: note = n-mer motif
ERNPISD

SEQ ID NO: 1568 - protein, 7 aa, synthetic construct
  REGION 1..7: note = n-mer motif
VSSGHTK

SEQ ID NO: 1569 - protein, 7 aa, synthetic construct
  REGION 1..7: note = n-mer motif
KYTESNA

SEQ ID NO: 1570 - protein, 7 aa, synthetic construct
  REGION 1..7: note = n-mer motif
NRNSVGT

SEQ ID NO: 1571 - protein, 7 aa, synthetic construct
  REGION 1..7: note = n-mer motif
HESHYVS

SEQ ID NO: 1572 - protein, 7 aa, synthetic construct
  REGION 1..7: note = n-mer motif
TTGGTGM

SEQ ID NO: 1573 - protein, 7 aa, synthetic construct
  REGION 1..7: note = n-mer motif
ATDKMTP

SEQ ID NO: 1574 - protein, 7 aa, synthetic construct
  REGION 1..7: note = n-mer motif
SASSGAT

SEQ ID NO: 1575 - protein, 7 aa, synthetic construct
  REGION 1..7: note = n-mer motif
STTTGHM

SEQ ID NO: 1576 - protein, 7 aa, synthetic construct
  REGION 1..7: note = n-mer motif
IIASSTT

SEQ ID NO: 1577 - protein, 7 aa, synthetic construct
  REGION 1..7: note = n-mer motif
DTGSRIA

SEQ ID NO: 1578 - protein, 7 aa, synthetic construct
  REGION 1..7: note = n-mer motif
WADDSQR

SEQ ID NO: 1579 - protein, 7 aa, synthetic construct
  REGION 1..7: note = n-mer motif
RGNTLEM

SEQ ID NO: 1580 - protein, 7 aa, synthetic construct
  REGION 1..7: note = n-mer motif
NLQVNAN

SEQ ID NO: 1581 - protein, 7 aa, synthetic construct
  REGION 1..7: note = n-mer motif
ATTQLMT

SEQ ID NO: 1582 - protein, 7 aa, synthetic construct
  REGION 1..7: note = n-mer motif
ADTNIIV

SEQ ID NO: 1583 - protein, 7 aa, synthetic construct
  REGION 1..7: note = n-mer motif
AITITQK

SEQ ID NO: 1584 - protein, 7 aa, synthetic construct
  REGION 1..7: note = n-mer motif
DSNKGAT

SEQ ID NO: 1585 - protein, 7 aa, synthetic construct
  REGION 1..7: note = n-mer motif
GNASGNP

SEQ ID NO: 1586 - protein, 7 aa, synthetic construct
  REGION 1..7: note = n-mer motif
TMGAKGT

SEQ ID NO: 1587 - protein, 7 aa, synthetic construct
  REGION 1..7: note = n-mer motif
YLQTGTL

SEQ ID NO: 1588 - protein, 7 aa, synthetic construct
  REGION 1..7: note = n-mer motif
ALHTKDL

SEQ ID NO: 1589 - protein, 7 aa, synthetic construct
  REGION 1..7: note = n-mer motif
VDKSEAV

SEQ ID NO: 1590 - protein, 7 aa, synthetic construct
  REGION 1..7: note = n-mer motif
GRTDLMA

SEQ ID NO: 1591 - protein, 7 aa, synthetic construct
  REGION 1..7: note = n-mer motif
GTEPRTA

SEQ ID NO: 1592 - protein, 7 aa, synthetic construct
  REGION 1..7: note = n-mer motif
RGDMSRE

SEQ ID NO: 1593 - protein, 7 aa, synthetic construct
  REGION 1..7: note = n-mer motif
RGDTKSK

SEQ ID NO: 1594 - protein, 7 aa, synthetic construct
  REGION 1..7: note = n-mer motif
GTLASMS

SEQ ID NO: 1595 - protein, 7 aa, synthetic construct
  REGION 1..7: note = n-mer motif
QKSVTYS

SEQ ID NO: 1596 - protein, 7 aa, synthetic construct
  REGION 1..7: note = n-mer motif
STGQTLV

SEQ ID NO: 1597 - protein, 7 aa, synthetic construct
  REGION 1..7: note = n-mer motif
SHINMGS

SEQ ID NO: 1598 - protein, 7 aa, synthetic construct
  REGION 1..7: note = n-mer motif
ALNGTGN

SEQ ID NO: 1599 - protein, 7 aa, synthetic construct
  REGION 1..7: note = n-mer motif
TTSSNQH

SEQ ID NO: 1600 - protein, 7 aa, synthetic construct
  REGION 1..7: note = n-mer motif
KNYASTD

SEQ ID NO: 1601 - protein, 7 aa, synthetic construct
  REGION 1..7: note = n-mer motif
ESTSRTY

SEQ ID NO: 1602 - protein, 7 aa, synthetic construct
  REGION 1..7: note = n-mer motif
PRSITEL

SEQ ID NO: 1603 - protein, 7 aa, synthetic construct
  REGION 1..7: note = n-mer motif
YIAGGEK

SEQ ID NO: 1604 - protein, 7 aa, synthetic construct
  REGION 1..7: note = n-mer motif
TSNYMHE

SEQ ID NO: 1605 - protein, 7 aa, synthetic construct
  REGION 1..7: note = n-mer motif
LDPNSTR

SEQ ID NO: 1606 - protein, 7 aa, synthetic construct
  REGION 1..7: note = n-mer motif
HSDMGSS

SEQ ID NO: 1607 - protein, 7 aa, synthetic construct
  REGION 1..7: note = n-mer motif
DTANRST

SEQ ID NO: 1608 - protein, 7 aa, synthetic construct
  REGION 1..7: note = n-mer motif
NAGHSGQ

SEQ ID NO: 1609 - protein, 7 aa, synthetic construct
  REGION 1..7: note = n-mer motif
SLGSDRM

SEQ ID NO: 1610 - protein, 7 aa, synthetic construct
  REGION 1..7: note = n-mer motif
DNQQALA

SEQ ID NO: 1611 - protein, 7 aa, synthetic construct
  REGION 1..7: note = n-mer motif
PSSAGST

SEQ ID NO: 1612 - protein, 7 aa, synthetic construct
  REGION 1..7: note = n-mer motif
DRKGYDA

SEQ ID NO: 1613 - protein, 7 aa, synthetic construct
  REGION 1..7: note = n-mer motif
GGNQNLT

SEQ ID NO: 1614 - protein, 7 aa, synthetic construct
  REGION 1..7: note = n-mer motif
VNLNETE

SEQ ID NO: 1615 - protein, 7 aa, synthetic construct
  REGION 1..7: note = n-mer motif
SPGNGLL

SEQ ID NO: 1616 - protein, 7 aa, synthetic construct
  REGION 1..7: note = n-mer motif
SVGDLTK

SEQ ID NO: 1617 - protein, 7 aa, synthetic construct
  REGION 1..7: note = n-mer motif
RYESVGL

SEQ ID NO: 1618 - protein, 7 aa, synthetic construct
  REGION 1..7: note = n-mer motif
TRELTKN

SEQ ID NO: 1619 - protein, 7 aa, synthetic construct
  REGION 1..7: note = n-mer motif
TPTNGNP

SEQ ID NO: 1620 - protein, 7 aa, synthetic construct
  REGION 1..7: note = n-mer motif
ATDQRSR

SEQ ID NO: 1621 - protein, 7 aa, synthetic construct
  REGION 1..7: note = n-mer motif
GTSAESR

SEQ ID NO: 1622 - protein, 7 aa, synthetic construct
  REGION 1..7: note = n-mer motif
RMLSTLP

SEQ ID NO: 1623 - protein, 7 aa, synthetic construct
  REGION 1..7: note = n-mer motif
GINSSHF

SEQ ID NO: 1624 - protein, 7 aa, synthetic construct
  REGION 1..7: note = n-mer motif
SSSTEGQ

SEQ ID NO: 1625 - protein, 7 aa, synthetic construct
  REGION 1..7: note = n-mer motif
DKQQTGQ

SEQ ID NO: 1626 - protein, 7 aa, synthetic construct
  REGION 1..7: note = n-mer motif
TQHLPST

SEQ ID NO: 1627 - protein, 7 aa, synthetic construct
  REGION 1..7: note = n-mer motif
GLGQPQL

SEQ ID NO: 1628 - protein, 7 aa, synthetic construct
  REGION 1..7: note = n-mer motif
VTNESRA

SEQ ID NO: 1629 - protein, 7 aa, synthetic construct
  REGION 1..7: note = n-mer motif
GNSNYRE

SEQ ID NO: 1630 - protein, 7 aa, synthetic construct
  REGION 1..7: note = n-mer motif
WNAENSK

SEQ ID NO: 1631 - protein, 7 aa, synthetic construct
  REGION 1..7: note = n-mer motif
PGSQRQD

SEQ ID NO: 1632 - protein, 7 aa, synthetic construct
  REGION 1..7: note = n-mer motif
HTYSQAD

SEQ ID NO: 1633 - protein, 7 aa, synthetic construct
  REGION 1..7: note = n-mer motif
TAGNLRS

SEQ ID NO: 1634 - protein, 7 aa, synthetic construct
  REGION 1..7: note = n-mer motif
GRHLQSD

SEQ ID NO: 1635 - protein, 7 aa, synthetic construct
  REGION 1..7: note = n-mer motif
NNAHTAT

SEQ ID NO: 1636 - protein, 7 aa, synthetic construct
  REGION 1..7: note = n-mer motif
STSQENR

SEQ ID NO: 1637 - protein, 7 aa, synthetic construct
  REGION 1..7: note = n-mer motif
RGDTMNY

SEQ ID NO: 1638 - protein, 7 aa, synthetic construct
  REGION 1..7: note = n-mer motif
PVATQHA

SEQ ID NO: 1639 - protein, 7 aa, synthetic construct
  REGION 1..7: note = n-mer motif
GHLNAPT

SEQ ID NO: 1640 - protein, 7 aa, synthetic construct
  REGION 1..7: note = n-mer motif
QILNYSV

SEQ ID NO: 1641 - protein, 7 aa, synthetic construct
  REGION 1..7: note = n-mer motif
QNHASGE

SEQ ID NO: 1642 - protein, 7 aa, synthetic construct
  REGION 1..7: note = n-mer motif
GLTGREL

SEQ ID NO: 1643 - protein, 7 aa, synthetic construct
  REGION 1..7: note = n-mer motif
DVAVTQH

SEQ ID NO: 1644 - protein, 7 aa, synthetic construct
  REGION 1..7: note = n-mer motif
ATYTGRT

SEQ ID NO: 1645 - protein, 7 aa, synthetic construct
  REGION 1..7: note = n-mer motif
KELQWQR

SEQ ID NO: 1646 - protein, 7 aa, synthetic construct
  REGION 1..7: note = n-mer motif
ASYSSMV

SEQ ID NO: 1647 - protein, 7 aa, synthetic construct
  REGION 1..7: note = n-mer motif
VISHGAL

SEQ ID NO: 1648 - protein, 7 aa, synthetic construct
  REGION 1..7: note = n-mer motif
PIHHGSS

SEQ ID NO: 1649 - protein, 7 aa, synthetic construct
  REGION 1..7: note = n-mer motif
VDKNHPL

SEQ ID NO: 1650 - protein, 7 aa, synthetic construct
  REGION 1..7: note = n-mer motif
TSGDRYT

SEQ ID NO: 1651 - protein, 7 aa, synthetic construct
  REGION 1..7: note = n-mer motif
GTKSWPV

SEQ ID NO: 1652 - protein, 7 aa, synthetic construct
  REGION 1..7: note = n-mer motif
YNAHESF

SEQ ID NO: 1653 - protein, 7 aa, synthetic construct
  REGION 1..7: note = n-mer motif
RVHDTPS

SEQ ID NO: 1654 - protein, 7 aa, synthetic construct
  REGION 1..7: note = n-mer motif
AQIESGR

SEQ ID NO: 1655 - protein, 7 aa, synthetic construct
  REGION 1..7: note = n-mer motif
WKDNMRM

SEQ ID NO: 1656 - protein, 7 aa, synthetic construct
  REGION 1..7: note = n-mer motif
MPSEPPG

SEQ ID NO: 1657 - protein, 7 aa, synthetic construct
  REGION 1..7: note = n-mer motif
RGDYPTS

SEQ ID NO: 1658 - protein, 7 aa, synthetic construct
  REGION 1..7: note = n-mer motif
FHNESYG

SEQ ID NO: 1659 - protein, 7 aa, synthetic construct
  REGION 1..7: note = n-mer motif
LNTMIDK

SEQ ID NO: 1660 - protein, 7 aa, synthetic construct
  REGION 1..7: note = n-mer motif
STLSQGA

SEQ ID NO: 1661 - protein, 7 aa, synthetic construct
  REGION 1..7: note = n-mer motif
PLHNIPP

SEQ ID NO: 1662 - protein, 7 aa, synthetic construct
  REGION 1..7: note = n-mer motif
ASSTFLP

SEQ ID NO: 1663 - protein, 7 aa, synthetic construct
  REGION 1..7: note = n-mer motif
MEGMGLG

SEQ ID NO: 1664 - protein, 7 aa, synthetic construct
  REGION 1..7: note = n-mer motif
KDYKPYA

SEQ ID NO: 1665 - protein, 7 aa, synthetic construct
  REGION 1..7: note = n-mer motif
NLQSGVQ

SEQ ID NO: 1666 - protein, 7 aa, synthetic construct
  REGION 1..7: note = n-mer motif
TTLSQQS

SEQ ID NO: 1667 - protein, 7 aa, synthetic construct
  REGION 1..7: note = n-mer motif
LMSSTSS

SEQ ID NO: 1668 - protein, 7 aa, synthetic construct
  REGION 1..7: note = n-mer motif
TGQGFSA

SEQ ID NO: 1669 - protein, 7 aa, synthetic construct
  REGION 1..7: note = n-mer motif
STIGNST

SEQ ID NO: 1670 - protein, 7 aa, synthetic construct
  REGION 1..7: note = n-mer motif
LRASEAP

SEQ ID NO: 1671 - protein, 7 aa, synthetic construct
  REGION 1..7: note = n-mer motif
QPNNGNH

SEQ ID NO: 1672 - protein, 7 aa, synthetic construct
  REGION 1..7: note = n-mer motif
SSDVTRQ

SEQ ID NO: 1673 - protein, 7 aa, synthetic construct
  REGION 1..7: note = n-mer motif
RGDATEM

SEQ ID NO: 1674 - protein, 7 aa, synthetic construct
  REGION 1..7: note = n-mer motif
YRGREDW

SEQ ID NO: 1675 - protein, 7 aa, synthetic construct
  REGION 1..7: note = n-mer motif
SLQQSQL

SEQ ID NO: 1676 - protein, 7 aa, synthetic construct
  REGION 1..7: note = n-mer motif
KPTANDW

SEQ ID NO: 1677 - protein, 7 aa, synthetic construct
  REGION 1..7: note = n-mer motif
RLTDTMH

SEQ ID NO: 1678 - protein, 7 aa, synthetic construct
  REGION 1..7: note = n-mer motif
LHGNYSP

SEQ ID NO: 1679 - protein, 7 aa, synthetic construct
  REGION 1..7: note = n-mer motif
IPVGAMA

SEQ ID NO: 1680 - protein, 7 aa, synthetic construct
  REGION 1..7: note = n-mer motif
PNTASNF

SEQ ID NO: 1681 - protein, 7 aa, synthetic construct
  REGION 1..7: note = n-mer motif
TSREVKG

SEQ ID NO: 1682 - protein, 7 aa, synthetic construct
  REGION 1..7: note = n-mer motif
DTSSGNR

SEQ ID NO: 1683 - protein, 7 aa, synthetic construct
  REGION 1..7: note = n-mer motif
EAVTSKW

SEQ ID NO: 1684 - protein, 7 aa, synthetic construct
  REGION 1..7: note = n-mer motif
LITATTN

SEQ ID NO: 1685 - protein, 7 aa, synthetic construct
  REGION 1..7: note = n-mer motif
DGGRSGI

SEQ ID NO: 1686 - protein, 7 aa, synthetic construct
  REGION 1..7: note = n-mer motif
FMEVMKN

SEQ ID NO: 1687 - protein, 7 aa, synthetic construct
  REGION 1..7: note = n-mer motif
SYQNPPP

SEQ ID NO: 1688 - protein, 7 aa, synthetic construct
  REGION 1..7: note = n-mer motif
TNVTFKL

SEQ ID NO: 1689 - protein, 7 aa, synthetic construct
  REGION 1..7: note = n-mer motif
ISTHTMT

SEQ ID NO: 1690 - protein, 7 aa, synthetic construct
  REGION 1..7: note = n-mer motif
ETQGARY

SEQ ID NO: 1691 - protein, 7 aa, synthetic construct
  REGION 1..7: note = n-mer motif
AAYEHAP

SEQ ID NO: 1692 - protein, 7 aa, synthetic construct
  REGION 1..7: note = n-mer motif
STNDRAL

SEQ ID NO: 1693 - protein, 7 aa, synthetic construct
  REGION 1..7: note = n-mer motif
FTERALQ

SEQ ID NO: 1694 - protein, 7 aa, synthetic construct
  REGION 1..7: note = n-mer motif
VAGLVDI

SEQ ID NO: 1695 - protein, 7 aa, synthetic construct
  REGION 1..7: note = n-mer motif
SSVTNLA

SEQ ID NO: 1696 - protein, 7 aa, synthetic construct
  REGION 1..7: note = n-mer motif
DTTTGHL

SEQ ID NO: 1697 - protein, 7 aa, synthetic construct
  REGION 1..7: note = n-mer motif
TRNLSES

SEQ ID NO: 1698 - protein, 7 aa, synthetic construct
  REGION 1..7: note = n-mer motif
QVNVGPG

SEQ ID NO: 1699 - protein, 7 aa, synthetic construct
  REGION 1..7: note = n-mer motif
KQTMSDT

SEQ ID NO: 1700 - protein, 7 aa, synthetic construct
  REGION 1..7: note = n-mer motif
MSTTSKT

SEQ ID NO: 1701 - protein, 7 aa, synthetic construct
  REGION 1..7: note = n-mer motif
TTIGTNQ

SEQ ID NO: 1702 - protein, 7 aa, synthetic construct
  REGION 1..7: note = n-mer motif
GTLTPNL

SEQ ID NO: 1703 - protein, 7 aa, synthetic construct
  REGION 1..7: note = n-mer motif
FDSYNIV

SEQ ID NO: 1704 - protein, 7 aa, synthetic construct
  REGION 1..7: note = n-mer motif
RGAPEQA

SEQ ID NO: 1705 - protein, 7 aa, synthetic construct
  REGION 1..7: note = n-mer motif
IENVNHL

SEQ ID NO: 1706 - protein, 7 aa, synthetic construct
  REGION 1..7: note = n-mer motif
RSLESQA

SEQ ID NO: 1707 - protein, 7 aa, synthetic construct
  REGION 1..7: note = n-mer motif
QYTSLSP

SEQ ID NO: 1708 - protein, 7 aa, synthetic construct
  REGION 1..7: note = n-mer motif
TKGYNDL

SEQ ID NO: 1709 - protein, 7 aa, synthetic construct
  REGION 1..7: note = n-mer motif
VASMVHN

SEQ ID NO: 1710 - protein, 7 aa, synthetic construct
  REGION 1..7: note = n-mer motif
STTHTSA

SEQ ID NO: 1711 - protein, 7 aa, synthetic construct
  REGION 1..7: note = n-mer motif
LAHPQPN

SEQ ID NO: 1712 - protein, 7 aa, synthetic construct
  REGION 1..7: note = n-mer motif
SINNIGA

SEQ ID NO: 1713 - protein, 7 aa, synthetic construct
  REGION 1..7: note = n-mer motif
AIDSIKM

SEQ ID NO: 1714 - protein, 7 aa, synthetic construct
  REGION 1..7: note = n-mer motif
SMYGQAG

SEQ ID NO: 1715 - protein, 7 aa, synthetic construct
  REGION 1..7: note = n-mer motif
EYANAKT

SEQ ID NO: 1716 - protein, 7 aa, synthetic construct
  REGION 1..7: note = n-mer motif
YRASDVA

SEQ ID NO: 1717 - protein, 7 aa, synthetic construct
  REGION 1..7: note = n-mer motif
VSLESRL

SEQ ID NO: 1718 - protein, 7 aa, synthetic construct
  REGION 1..7: note = n-mer motif
IETSSRS

SEQ ID NO: 1719 - protein, 7 aa, synthetic construct
  REGION 1..7: note = n-mer motif
MGVKPEQ

SEQ ID NO: 1720 - protein, 7 aa, synthetic construct
  REGION 1..7: note = n-mer motif
ALPSRER

SEQ ID NO: 1721 - protein, 7 aa, synthetic construct
  REGION 1..7: note = n-mer motif
GTGSSAH

SEQ ID NO: 1722 - protein, 7 aa, synthetic construct
  REGION 1..7: note = n-mer motif
QTNTNDR

SEQ ID NO: 1723 - protein, 7 aa, synthetic construct
  REGION 1..7: note = n-mer motif
VLHSVSA

SEQ ID NO: 1724 - protein, 7 aa, synthetic construct
  REGION 1..7: note = n-mer motif
PYSATDR

SEQ ID NO: 1725 - protein, 7 aa, synthetic construct
  REGION 1..7: note = n-mer motif
ANSGLHN

SEQ ID NO: 1726 - protein, 7 aa, synthetic construct
  REGION 1..7: note = n-mer motif
YESTHVN

SEQ ID NO: 1727 - protein, 7 aa, synthetic construct
  REGION 1..7: note = n-mer motif
NNALVGS

SEQ ID NO: 1728 - protein, 7 aa, synthetic construct
  REGION 1..7: note = n-mer motif
GINSSHI

SEQ ID NO: 1729 - protein, 7 aa, synthetic construct
  REGION 1..7: note = n-mer motif
SISDKNQ

SEQ ID NO: 1730 - protein, 7 aa, synthetic construct
  REGION 1..7: note = n-mer motif
DHQQALA

SEQ ID NO: 1731 - protein, 7 aa, synthetic construct
  REGION 1..7: note = n-mer motif
DSTKAMQ

SEQ ID NO: 1732 - protein, 7 aa, synthetic construct
  REGION 1..7: note = n-mer motif
TITSQSV

SEQ ID NO: 1733 - protein, 7 aa, synthetic construct
  REGION 1..7: note = n-mer motif
GARTILD

SEQ ID NO: 1734 - protein, 7 aa, synthetic construct
  REGION 1..7: note = n-mer motif
EHSPTTG

SEQ ID NO: 1735 - protein, 7 aa, synthetic construct
  REGION 1..7: note = n-mer motif
GLTGYPM

SEQ ID NO: 1736 - protein, 7 aa, synthetic construct
  REGION 1..7: note = n-mer motif
TMESGRH

SEQ ID NO: 1737 - protein, 7 aa, synthetic construct
  REGION 1..7: note = n-mer motif
SASKVEY

SEQ ID NO: 1738 - protein, 7 aa, synthetic construct
  REGION 1..7: note = n-mer motif
DKSNYSI

SEQ ID NO: 1739 - protein, 7 aa, synthetic construct
  REGION 1..7: note = n-mer motif
FNETAGR

SEQ ID NO: 1740 - protein, 7 aa, synthetic construct
  REGION 1..7: note = n-mer motif
QKSETYT

SEQ ID NO: 1741 - protein, 7 aa, synthetic construct
  REGION 1..7: note = n-mer motif
ALTRMPN

SEQ ID NO: 1742 - protein, 7 aa, synthetic construct
  REGION 1..7: note = n-mer motif
RNGSAQS

SEQ ID NO: 1743 - protein, 7 aa, synthetic construct
  REGION 1..7: note = n-mer motif
ARDTPGI

SEQ ID NO: 1744 - protein, 7 aa, synthetic construct
  REGION 1..7: note = n-mer motif
IVNAEIY

SEQ ID NO: 1745 - protein, 7 aa, synthetic construct
  REGION 1..7: note = n-mer motif
RQGDLKE

SEQ ID NO: 1746 - protein, 7 aa, synthetic construct
  REGION 1..7: note = n-mer motif
RNNPSHD

SEQ ID NO: 1747 - protein, 7 aa, synthetic construct
  REGION 1..7: note = n-mer motif
LAHNYLS

SEQ ID NO: 1748 - protein, 7 aa, synthetic construct
  REGION 1..7: note = n-mer motif
NTHNLQM

SEQ ID NO: 1749 - protein, 7 aa, synthetic construct
  REGION 1..7: note = n-mer motif
RGDHSTQ

SEQ ID NO: 1750 - protein, 7 aa, synthetic construct
  REGION 1..7: note = n-mer motif
LHGVSSI

SEQ ID NO: 1751 - protein, 7 aa, synthetic construct
  REGION 1..7: note = n-mer motif
GINHVAS

SEQ ID NO: 1752 - protein, 7 aa, synthetic construct
  REGION 1..7: note = n-mer motif
TDKLQGV

SEQ ID NO: 1753 - protein, 7 aa, synthetic construct
  REGION 1..7: note = n-mer motif
GTSIDYV

SEQ ID NO: 1754 - protein, 7 aa, synthetic construct
  REGION 1..7: note = n-mer motif
SNTAPPP

SEQ ID NO: 1755 - protein, 7 aa, synthetic construct
  REGION 1..7: note = n-mer motif
TAKSYGP

SEQ ID NO: 1756 - protein, 7 aa, synthetic construct
  REGION 1..7: note = n-mer motif
DHQQALA

SEQ ID NO: 1757 - protein, 7 aa, synthetic construct
  REGION 1..7: note = n-mer motif
TQVVART

SEQ ID NO: 1758 - protein, 7 aa, synthetic construct
  REGION 1..7: note = n-mer motif
SPPSTSG

SEQ ID NO: 1759 - protein, 7 aa, synthetic construct
  REGION 1..7: note = n-mer motif
PMRTPPY

SEQ ID NO: 1760 - protein, 7 aa, synthetic construct
  REGION 1..7: note = n-mer motif
AAGNTTR

SEQ ID NO: 1761 - protein, 6 aa, synthetic construct
  REGION 1..6: note = n-mer motif
RGDSTP

SEQ ID NO: 1762 - protein, 7 aa, synthetic construct
  REGION 1..7: note = n-mer motif
LAKTVAI

SEQ ID NO: 1763 - protein, 7 aa, synthetic construct
  REGION 1..7: note = n-mer motif
SKSENLQ

SEQ ID NO: 1764 - protein, 7 aa, synthetic construct
  REGION 1..7: note = n-mer motif
TQTSYAT

SEQ ID NO: 1765 - protein, 7 aa, synthetic construct
  REGION 1..7: note = n-mer motif
TGDRTSV

SEQ ID NO: 1766 - protein, 7 aa, synthetic construct
  REGION 1..7: note = n-mer motif
ISQGSSL

SEQ ID NO: 1767 - protein, 7 aa, synthetic construct
  REGION 1..7: note = n-mer motif
LVQMGSV

SEQ ID NO: 1768 - protein, 7 aa, synthetic construct
  REGION 1..7: note = n-mer motif
LSATSTM

SEQ ID NO: 1769 - protein, 7 aa, synthetic construct
  REGION 1..7: note = n-mer motif
QNHNELK

SEQ ID NO: 1770 - protein, 7 aa, synthetic construct
  REGION 1..7: note = n-mer motif
RGAPEHA

SEQ ID NO: 1771 - protein, 7 aa, synthetic construct
  REGION 1..7: note = n-mer motif
SSFGKDN

SEQ ID NO: 1772 - protein, 7 aa, synthetic construct
  REGION 1..7: note = n-mer motif
NANAGGN

SEQ ID NO: 1773 - protein, 7 aa, synthetic construct
  REGION 1..7: note = n-mer motif
DHHPQSR

SEQ ID NO: 1774 - protein, 7 aa, synthetic construct
  REGION 1..7: note = n-mer motif
MRHEAPL

SEQ ID NO: 1775 - protein, 7 aa, synthetic construct
  REGION 1..7: note = n-mer motif
KGDGAYE

SEQ ID NO: 1776 - protein, 7 aa, synthetic construct
  REGION 1..7: note = n-mer motif
PMNGILL

SEQ ID NO: 1777 - protein, 7 aa, synthetic construct
  REGION 1..7: note = n-mer motif
SSGGMKA

SEQ ID NO: 1778 - protein, 7 aa, synthetic construct
  REGION 1..7: note = n-mer motif
VLVTQNH

SEQ ID NO: 1779 - protein, 7 aa, synthetic construct
  REGION 1..7: note = n-mer motif
EINNRTG

SEQ ID NO: 1780 - protein, 7 aa, synthetic construct
  REGION 1..7: note = n-mer motif
LPTGVLP

SEQ ID NO: 1781 - protein, 7 aa, synthetic construct
  REGION 1..7: note = n-mer motif
AYGIREV

SEQ ID NO: 1782 - protein, 7 aa, synthetic construct
  REGION 1..7: note = n-mer motif
STNSIGA

SEQ ID NO: 1783 - protein, 7 aa, synthetic construct
  REGION 1..7: note = n-mer motif
VQLTHNG

SEQ ID NO: 1784 - protein, 7 aa, synthetic construct
  REGION 1..7: note = n-mer motif
VQLENAN

SEQ ID NO: 1785 - protein, 7 aa, synthetic construct
  REGION 1..7: note = n-mer motif
GKANDGS

SEQ ID NO: 1786 - protein, 7 aa, synthetic construct
  REGION 1..7: note = n-mer motif
TGVRETI

SEQ ID NO: 1787 - protein, 7 aa, synthetic construct
  REGION 1..7: note = n-mer motif
GLNQITS

SEQ ID NO: 1788 - protein, 7 aa, synthetic construct
  REGION 1..7: note = n-mer motif
TEKASPL

SEQ ID NO: 1789 - protein, 7 aa, synthetic construct
  REGION 1..7: note = n-mer motif
FLEGVAQ

SEQ ID NO: 1790 - protein, 7 aa, synthetic construct
  REGION 1..7: note = n-mer motif
TNYNIGP

SEQ ID NO: 1791 - protein, 7 aa, synthetic construct
  REGION 1..7: note = n-mer motif
RGDLTTT

SEQ ID NO: 1792 - protein, 7 aa, synthetic construct
  REGION 1..7: note = n-mer motif
MMNVSGH

SEQ ID NO: 1793 - protein, 7 aa, synthetic construct
  REGION 1..7: note = n-mer motif
SQSINGL

SEQ ID NO: 1794 - protein, 7 aa, synthetic construct
  REGION 1..7: note = n-mer motif
LTTLTNH

SEQ ID NO: 1795 - protein, 7 aa, synthetic construct
  REGION 1..7: note = n-mer motif
NSVQSTP

SEQ ID NO: 1796 - protein, 7 aa, synthetic construct
  REGION 1..7: note = n-mer motif
YNTDRTN

SEQ ID NO: 1797 - protein, 7 aa, synthetic construct
  REGION 1..7: note = n-mer motif
EKPQHNS

SEQ ID NO: 1798 - protein, 7 aa, synthetic construct
  REGION 1..7: note = n-mer motif
TMATNLS

SEQ ID NO: 1799 - protein, 7 aa, synthetic construct
  REGION 1..7: note = n-mer motif
VGTHLHS

SEQ ID NO: 1800 - protein, 7 aa, synthetic construct
  REGION 1..7: note = n-mer motif
DAHHSSS

SEQ ID NO: 1801 - protein, 7 aa, synthetic construct
  REGION 1..7: note = n-mer motif
LVGTLVY

SEQ ID NO: 1802 - protein, 7 aa, synthetic construct
  REGION 1..7: note = n-mer motif
YGVQANS

SEQ ID NO: 1803 - protein, 7 aa, synthetic construct
  REGION 1..7: note = n-mer motif
VLSDKAY

SEQ ID NO: 1804 - protein, 7 aa, synthetic construct
  REGION 1..7: note = n-mer motif
LEGQNKT

SEQ ID NO: 1805 - protein, 7 aa, synthetic construct
  REGION 1..7: note = n-mer motif
EVSNNNY

SEQ ID NO: 1806 - protein, 7 aa, synthetic construct
  REGION 1..7: note = n-mer motif
AHQQALA

SEQ ID NO: 1807 - protein, 7 aa, synthetic construct
  REGION 1..7: note = n-mer motif
LPTTLNH

SEQ ID NO: 1808 - protein, 7 aa, synthetic construct
  REGION 1..7: note = n-mer motif
YIAGGEQ

SEQ ID NO: 1809 - protein, 7 aa, synthetic construct
  REGION 1..7: note = n-mer motif
NSGTLYQ

SEQ ID NO: 1810 - protein, 7 aa, synthetic construct
  REGION 1..7: note = n-mer motif
RGLPDVN

SEQ ID NO: 1811 - protein, 7 aa, synthetic construct
  REGION 1..7: note = n-mer motif
NQQLSHS

SEQ ID NO: 1812 - protein, 7 aa, synthetic construct
  REGION 1..7: note = n-mer motif
NPSYDHR

SEQ ID NO: 1813 - protein, 7 aa, synthetic construct
  REGION 1..7: note = n-mer motif
IDSDTFV

SEQ ID NO: 1814 - protein, 7 aa, synthetic construct
  REGION 1..7: note = n-mer motif
TAYLAGL

SEQ ID NO: 1815 - protein, 7 aa, synthetic construct
  REGION 1..7: note = n-mer motif
HSNVSLE

SEQ ID NO: 1816 - protein, 7 aa, synthetic construct
  REGION 1..7: note = n-mer motif
GNNLSLS

SEQ ID NO: 1817 - protein, 7 aa, synthetic construct
  REGION 1..7: note = n-mer motif
VMDTHGM

SEQ ID NO: 1818 - protein, 7 aa, synthetic construct
  REGION 1..7: note = n-mer motif
AYNMSSV

SEQ ID NO: 1819 - protein, 7 aa, synthetic construct
  REGION 1..7: note = n-mer motif
TNAISQT

SEQ ID NO: 1820 - protein, 7 aa, synthetic construct
  REGION 1..7: note = n-mer motif
ATHAMRP

SEQ ID NO: 1821 - protein, 7 aa, synthetic construct
  REGION 1..7: note = n-mer motif
MLNNTMM

SEQ ID NO: 1822 - protein, 7 aa, synthetic construct
  REGION 1..7: note = n-mer motif
ISSGILS

SEQ ID NO: 1823 - protein, 7 aa, synthetic construct
  REGION 1..7: note = n-mer motif
RQGSLMI

SEQ ID NO: 1824 - protein, 7 aa, synthetic construct
  REGION 1..7: note = n-mer motif
TTDKGIN

SEQ ID NO: 1825 - protein, 7 aa, synthetic construct
  REGION 1..7: note = n-mer motif
HNLMTQI

SEQ ID NO: 1826 - protein, 7 aa, synthetic construct
  REGION 1..7: note = n-mer motif
NQNTYEL

SEQ ID NO: 1827 - protein, 7 aa, synthetic construct
  REGION 1..7: note = n-mer motif
ANTVTER

SEQ ID NO: 1828 - protein, 7 aa, synthetic construct
  REGION 1..7: note = n-mer motif
STLQTNG

SEQ ID NO: 1829 - protein, 7 aa, synthetic construct
  REGION 1..7: note = n-mer motif
PNEYKAP

SEQ ID NO: 1830 - protein, 7 aa, synthetic construct
  REGION 1..7: note = n-mer motif
MQTRSDT

SEQ ID NO: 1831 - protein, 7 aa, synthetic construct
  REGION 1..7: note = n-mer motif
GTGYAGS

SEQ ID NO: 1832 - protein, 7 aa, synthetic construct
  REGION 1..7: note = n-mer motif
MGMQNTH

SEQ ID NO: 1833 - protein, 7 aa, synthetic construct
  REGION 1..7: note = n-mer motif
SSKERTS

SEQ ID NO: 1834 - protein, 7 aa, synthetic construct
  REGION 1..7: note = n-mer motif
RTDTPYT

SEQ ID NO: 1835 - protein, 7 aa, synthetic construct
  REGION 1..7: note = n-mer motif
TALRDNK

SEQ ID NO: 1836 - protein, 7 aa, synthetic construct
  REGION 1..7: note = n-mer motif
RMSESSD

SEQ ID NO: 1837 - protein, 7 aa, synthetic construct
  REGION 1..7: note = n-mer motif
NQSISMD

SEQ ID NO: 1838 - protein, 7 aa, synthetic construct
  REGION 1..7: note = n-mer motif
SLGHSNN

SEQ ID NO: 1839 - protein, 7 aa, synthetic construct
  REGION 1..7: note = n-mer motif
LNSGGAM

SEQ ID NO: 1840 - protein, 7 aa, synthetic construct
  REGION 1..7: note = n-mer motif
NEQFEKV

SEQ ID NO: 1841 - protein, 7 aa, synthetic construct
  REGION 1..7: note = n-mer motif
MMANNMQ

SEQ ID NO: 1842 - protein, 7 aa, synthetic construct
  REGION 1..7: note = n-mer motif
SRREEQP

SEQ ID NO: 1843 - protein, 7 aa, synthetic construct
  REGION 1..7: note = n-mer motif
ATMTSST

SEQ ID NO: 1844 - protein, 7 aa, synthetic construct
  REGION 1..7: note = n-mer motif
RGSDGGL

SEQ ID NO: 1845 - protein, 7 aa, synthetic construct
  REGION 1..7: note = n-mer motif
SLTPNNL

SEQ ID NO: 1846 - protein, 7 aa, synthetic construct
  REGION 1..7: note = n-mer motif
ATLSPHA

SEQ ID NO: 1847 - protein, 7 aa, synthetic construct
  REGION 1..7: note = n-mer motif
YLQEKFP

SEQ ID NO: 1848 - protein, 7 aa, synthetic construct
  REGION 1..7: note = n-mer motif
GTGYPNQ

SEQ ID NO: 1849 - protein, 7 aa, synthetic construct
  REGION 1..7: note = n-mer motif
NYPSVQE

SEQ ID NO: 1850 - protein, 7 aa, synthetic construct
  REGION 1..7: note = n-mer motif
TDASGRS

SEQ ID NO: 1851 - protein, 7 aa, synthetic construct
  REGION 1..7: note = n-mer motif
RVITAGD

SEQ ID NO: 1852 - protein, 7 aa, synthetic construct
  REGION 1..7: note = n-mer motif
VTVSNSL

SEQ ID NO: 1853 - protein, 7 aa, synthetic construct
  REGION 1..7: note = n-mer motif
LLTAPHR

SEQ ID NO: 1854 - protein, 7 aa, synthetic construct
  REGION 1..7: note = n-mer motif
SIANHMI

SEQ ID NO: 1855 - protein, 7 aa, synthetic construct
  REGION 1..7: note = n-mer motif
MPSKGEV

SEQ ID NO: 1856 - protein, 7 aa, synthetic construct
  REGION 1..7: note = n-mer motif
NMTNERL

SEQ ID NO: 1857 - protein, 7 aa, synthetic construct
  REGION 1..7: note = n-mer motif
SFSSGIM

SEQ ID NO: 1858 - protein, 7 aa, synthetic construct
  REGION 1..7: note = n-mer motif
RDRQDSV

SEQ ID NO: 1859 - protein, 7 aa, synthetic construct
  REGION 1..7: note = n-mer motif
HGDRTAL

SEQ ID NO: 1860 - protein, 7 aa, synthetic construct
  REGION 1..7: note = n-mer motif
EVRGSVP

SEQ ID NO: 1861 - protein, 7 aa, synthetic construct
  REGION 1..7: note = n-mer motif
LISTGNN

SEQ ID NO: 1862 - protein, 7 aa, synthetic construct
  REGION 1..7: note = n-mer motif
PTSGDKP

SEQ ID NO: 1863 - protein, 7 aa, synthetic construct
  REGION 1..7: note = n-mer motif
KADHSGA

SEQ ID NO: 1864 - protein, 7 aa, synthetic construct
  REGION 1..7: note = n-mer motif
LNDVYRK

SEQ ID NO: 1865 - protein, 7 aa, synthetic construct
  REGION 1..7: note = n-mer motif
NSLQASA

SEQ ID NO: 1866 - protein, 7 aa, synthetic construct
  REGION 1..7: note = n-mer motif
YHNEIMT

SEQ ID NO: 1867 - protein, 7 aa, synthetic construct
  REGION 1..7: note = n-mer motif
NNTLNIL

SEQ ID NO: 1868 - protein, 7 aa, synthetic construct
  REGION 1..7: note = n-mer motif
SYGQGLE

SEQ ID NO: 1869 - protein, 7 aa, synthetic construct
  REGION 1..7: note = n-mer motif
MIKTNML

SEQ ID NO: 1870 - protein, 7 aa, synthetic construct
  REGION 1..7: note = n-mer motif
TEAGRPQ

SEQ ID NO: 1871 - protein, 7 aa, synthetic construct
  REGION 1..7: note = n-mer motif
RIDQTNV

SEQ ID NO: 1872 - protein, 7 aa, synthetic construct
  REGION 1..7: note = n-mer motif
EGHNRGI

SEQ ID NO: 1873 - protein, 7 aa, synthetic construct
  REGION 1..7: note = n-mer motif
MGTEYRM

SEQ ID NO: 1874 - protein, 7 aa, synthetic construct
  REGION 1..7: note = n-mer motif
SGMNSNK

SEQ ID NO: 1875 - protein, 7 aa, synthetic construct
  REGION 1..7: note = n-mer motif
LTNDNKL

SEQ ID NO: 1876 - protein, 7 aa, synthetic construct
  REGION 1..7: note = n-mer motif
LHNYQDR

SEQ ID NO: 1877 - protein, 7 aa, synthetic construct
  REGION 1..7: note = n-mer motif
KSNLEGK

SEQ ID NO: 1878 - protein, 7 aa, synthetic construct
  REGION 1..7: note = n-mer motif
LTGQNAI

SEQ ID NO: 1879 - protein, 7 aa, synthetic construct
  REGION 1..7: note = n-mer motif
HTVGAMH

SEQ ID NO: 1880 - protein, 7 aa, synthetic construct
  REGION 1..7: note = n-mer motif
LQLATSH

SEQ ID NO: 1881 - protein, 7 aa, synthetic construct
  REGION 1..7: note = n-mer motif
SLNGVLV

SEQ ID NO: 1882 - protein, 7 aa, synthetic construct
  REGION 1..7: note = n-mer motif
SHNQVNV

SEQ ID NO: 1883 - protein, 7 aa, synthetic construct
  REGION 1..7: note = n-mer motif
SLSTDVF

SEQ ID NO: 1884 - protein, 7 aa, synthetic construct
  REGION 1..7: note = n-mer motif
MVGRAEI

SEQ ID NO: 1885 - protein, 7 aa, synthetic construct
  REGION 1..7: note = n-mer motif
LSSMSTD

SEQ ID NO: 1886 - protein, 7 aa, synthetic construct
  REGION 1..7: note = n-mer motif
SYSTSTP

SEQ ID NO: 1887 - protein, 7 aa, synthetic construct
  REGION 1..7: note = n-mer motif
SELMVRP

SEQ ID NO: 1888 - protein, 7 aa, synthetic construct
  REGION 1..7: note = n-mer motif
WNGNATQ

SEQ ID NO: 1889 - protein, 7 aa, synthetic construct
  REGION 1..7: note = n-mer motif
MDTELYR

SEQ ID NO: 1890 - protein, 7 aa, synthetic construct
  REGION 1..7: note = n-mer motif
RTSPDTN

SEQ ID NO: 1891 - protein, 7 aa, synthetic construct
  REGION 1..7: note = n-mer motif
FSTQDIS

SEQ ID NO: 1892 - protein, 7 aa, synthetic construct
  REGION 1..7: note = n-mer motif
TTVLGNN

SEQ ID NO: 1893 - protein, 7 aa, synthetic construct
  REGION 1..7: note = n-mer motif
QRDAAYA

SEQ ID NO: 1894 - protein, 7 aa, synthetic construct
  REGION 1..7: note = n-mer motif
HQTVVPT

SEQ ID NO: 1895 - protein, 7 aa, synthetic construct
  REGION 1..7: note = n-mer motif
SNPGNHN

SEQ ID NO: 1896 - protein, 7 aa, synthetic construct
  REGION 1..7: note = n-mer motif
WETMAKP

SEQ ID NO: 1897 - protein, 7 aa, synthetic construct
  REGION 1..7: note = n-mer motif
GLYQNPT

SEQ ID NO: 1898 - protein, 7 aa, synthetic construct
  REGION 1..7: note = n-mer motif
LNLTNHN

SEQ ID NO: 1899 - protein, 7 aa, synthetic construct
  REGION 1..7: note = n-mer motif
MSLASTQ

SEQ ID NO: 1900 - protein, 7 aa, synthetic construct
  REGION 1..7: note = n-mer motif
TSQTVRV

SEQ ID NO: 1901 - protein, 7 aa, synthetic construct
  REGION 1..7: note = n-mer motif
GATVNTR

SEQ ID NO: 1902 - protein, 7 aa, synthetic construct
  REGION 1..7: note = n-mer motif
KGGNLTA

SEQ ID NO: 1903 - protein, 7 aa, synthetic construct
  REGION 1..7: note = n-mer motif
AWSQVLT

SEQ ID NO: 1904 - protein, 7 aa, synthetic construct
  REGION 1..7: note = n-mer motif
VEHVAHQ

SEQ ID NO: 1905 - protein, 7 aa, synthetic construct
  REGION 1..7: note = n-mer motif
LMSSYSS

SEQ ID NO: 1906 - protein, 7 aa, synthetic construct
  REGION 1..7: note = n-mer motif
SLGGNPP

SEQ ID NO: 1907 - protein, 7 aa, synthetic construct
  REGION 1..7: note = n-mer motif
KNENTNY

SEQ ID NO: 1908 - protein, 7 aa, synthetic construct
  REGION 1..7: note = n-mer motif
ILDNHRF

SEQ ID NO: 1909 - protein, 7 aa, synthetic construct
  REGION 1..7: note = n-mer motif
NSSHVNS

SEQ ID NO: 1910 - protein, 7 aa, synthetic construct
  REGION 1..7: note = n-mer motif
QVQHERV

SEQ ID NO: 1911 - protein, 7 aa, synthetic construct
  REGION 1..7: note = n-mer motif
LGGTLGI

SEQ ID NO: 1912 - protein, 7 aa, synthetic construct
  REGION 1..7: note = n-mer motif
TQERPLI

SEQ ID NO: 1913 - protein, 7 aa, synthetic construct
  REGION 1..7: note = n-mer motif
RKTEDRM

SEQ ID NO: 1914 - protein, 7 aa, synthetic construct
  REGION 1..7: note = n-mer motif
TELTARN

SEQ ID NO: 1915 - protein, 7 aa, synthetic construct
  REGION 1..7: note = n-mer motif
RGDNTYS

SEQ ID NO: 1916 - protein, 7 aa, synthetic construct
  REGION 1..7: note = n-mer motif
QSNTNNS

SEQ ID NO: 1917 - protein, 7 aa, synthetic construct
  REGION 1..7: note = n-mer motif
ASYSISD

SEQ ID NO: 1918 - protein, 7 aa, synthetic construct
  REGION 1..7: note = n-mer motif
SEHHAGI

SEQ ID NO: 1919 - protein, 7 aa, synthetic construct
  REGION 1..7: note = n-mer motif
RGAPEHA

SEQ ID NO: 1920 - protein, 7 aa, synthetic construct
  REGION 1..7: note = n-mer motif
NFSSGDV

SEQ ID NO: 1921 - protein, 7 aa, synthetic construct
  REGION 1..7: note = n-mer motif
SGINATD

SEQ ID NO: 1922 - protein, 7 aa, synthetic construct
  REGION 1..7: note = n-mer motif
RADVSWS

SEQ ID NO: 1923 - protein, 7 aa, synthetic construct
  REGION 1..7: note = n-mer motif
CMDVGKA

SEQ ID NO: 1924 - protein, 7 aa, synthetic construct
  REGION 1..7: note = n-mer motif
GVGATSV

SEQ ID NO: 1925 - protein, 7 aa, synthetic construct
  REGION 1..7: note = n-mer motif
KNNNSDS

SEQ ID NO: 1926 - protein, 7 aa, synthetic construct
  REGION 1..7: note = n-mer motif
NVASIDR

SEQ ID NO: 1927 - protein, 7 aa, synthetic construct
  REGION 1..7: note = n-mer motif
NSVNGLL

SEQ ID NO: 1928 - protein, 7 aa, synthetic construct
  REGION 1..7: note = n-mer motif
TLDRNQT

SEQ ID NO: 1929 - protein, 7 aa, synthetic construct
  REGION 1..7: note = n-mer motif
DQNFERR

SEQ ID NO: 1930 - protein, 7 aa, synthetic construct
  REGION 1..7: note = n-mer motif
VGDRNLV

SEQ ID NO: 1931 - protein, 7 aa, synthetic construct
  REGION 1..7: note = n-mer motif
LEVNLQT

SEQ ID NO: 1932 - protein, 7 aa, synthetic construct
  REGION 1..7: note = n-mer motif
TNGGSLN

SEQ ID NO: 1933 - protein, 7 aa, synthetic construct
  REGION 1..7: note = n-mer motif
FTRTPVT

SEQ ID NO: 1934 - protein, 7 aa, synthetic construct
  REGION 1..7: note = n-mer motif
TPAESKV

SEQ ID NO: 1935 - protein, 7 aa, synthetic construct
  REGION 1..7: note = n-mer motif
FPSHNGA

SEQ ID NO: 1936 - protein, 7 aa, synthetic construct
  REGION 1..7: note = n-mer motif
ARNVMLG

SEQ ID NO: 1937 - protein, 7 aa, synthetic construct
  REGION 1..7: note = n-mer motif
TIQDHIK

SEQ ID NO: 1938 - protein, 7 aa, synthetic construct
  REGION 1..7: note = n-mer motif
INSYLHE

SEQ ID NO: 1939 - protein, 7 aa, synthetic construct
  REGION 1..7: note = n-mer motif
AHDVTVN

SEQ ID NO: 1940 - protein, 7 aa, synthetic construct
  REGION 1..7: note = n-mer motif
TVGVQQT

SEQ ID NO: 1941 - protein, 7 aa, synthetic construct
  REGION 1..7: note = n-mer motif
TGSSDRL

SEQ ID NO: 1942 - protein, 7 aa, synthetic construct
  REGION 1..7: note = n-mer motif
NHDTAHA

SEQ ID NO: 1943 - protein, 7 aa, synthetic construct
  REGION 1..7: note = n-mer motif
AESQLAS

SEQ ID NO: 1944 - protein, 7 aa, synthetic construct
  REGION 1..7: note = n-mer motif
GNAYNTT

SEQ ID NO: 1945 - protein, 7 aa, synthetic construct
  REGION 1..7: note = n-mer motif
NHQAGTT

SEQ ID NO: 1946 - protein, 7 aa, synthetic construct
  REGION 1..7: note = n-mer motif
TVGENHR

SEQ ID NO: 1947 - protein, 7 aa, synthetic construct
  REGION 1..7: note = n-mer motif
LTTKIPL

SEQ ID NO: 1948 - protein, 7 aa, synthetic construct
  REGION 1..7: note = n-mer motif
TNYPEAN

SEQ ID NO: 1949 - protein, 7 aa, synthetic construct
  REGION 1..7: note = n-mer motif
NTAPPNH

SEQ ID NO: 1950 - protein, 7 aa, synthetic construct
  REGION 1..7: note = n-mer motif
VLSTGLR

SEQ ID NO: 1951 - protein, 7 aa, synthetic construct
  REGION 1..7: note = n-mer motif
LTSHSAG

SEQ ID NO: 1952 - protein, 7 aa, synthetic construct
  REGION 1..7: note = n-mer motif
MNKHGVL

SEQ ID NO: 1953 - protein, 7 aa, synthetic construct
  REGION 1..7: note = n-mer motif
DLTRAAI

SEQ ID NO: 1954 - protein, 7 aa, synthetic construct
  REGION 1..7: note = n-mer motif
YIVDHAN

SEQ ID NO: 1955 - protein, 7 aa, synthetic construct
  REGION 1..7: note = n-mer motif
SGPENTL

SEQ ID NO: 1956 - protein, 7 aa, synthetic construct
  REGION 1..7: note = n-mer motif
RYGDTGM

SEQ ID NO: 1957 - protein, 7 aa, synthetic construct
  REGION 1..7: note = n-mer motif
DGKNSYA

SEQ ID NO: 1958 - protein, 7 aa, synthetic construct
  REGION 1..7: note = n-mer motif
EAHNRVI

SEQ ID NO: 1959 - protein, 7 aa, synthetic construct
  REGION 1..7: note = n-mer motif
SLQAGRM

SEQ ID NO: 1960 - protein, 7 aa, synthetic construct
  REGION 1..7: note = n-mer motif
DAKALTT

SEQ ID NO: 1961 - protein, 7 aa, synthetic construct
  REGION 1..7: note = n-mer motif
TDTRKND

SEQ ID NO: 1962 - protein, 7 aa, synthetic construct
  REGION 1..7: note = n-mer motif
DSSHYST

SEQ ID NO: 1963 - protein, 7 aa, synthetic construct
  REGION 1..7: note = n-mer motif
TMHLPNL

SEQ ID NO: 1964 - protein, 7 aa, synthetic construct
  REGION 1..7: note = n-mer motif
RDGSTKV

SEQ ID NO: 1965 - protein, 7 aa, synthetic construct
  REGION 1..7: note = n-mer motif
SGYQMTE

SEQ ID NO: 1966 - protein, 7 aa, synthetic construct
  REGION 1..7: note = n-mer motif
CDLSQSC

SEQ ID NO: 1967 - protein, 7 aa, synthetic construct
  REGION 1..7: note = n-mer motif
RNASNGV

SEQ ID NO: 1968 - protein, 7 aa, synthetic construct
  REGION 1..7: note = n-mer motif
QSQNVTQ

SEQ ID NO: 1969 - protein, 7 aa, synthetic construct
  REGION 1..7: note = n-mer motif
DSAPSTI

SEQ ID NO: 1970 - protein, 7 aa, synthetic construct
  REGION 1..7: note = n-mer motif
RSVPSPH

SEQ ID NO: 1971 - protein, 7 aa, synthetic construct
  REGION 1..7: note = n-mer motif
MTSASRG

SEQ ID NO: 1972 - protein, 7 aa, synthetic construct
  REGION 1..7: note = n-mer motif
ALASRPM

SEQ ID NO: 1973 - protein, 7 aa, synthetic construct
  REGION 1..7: note = n-mer motif
LNLSNDW

SEQ ID NO: 1974 - protein, 7 aa, synthetic construct
  REGION 1..7: note = n-mer motif
VSTAQRQ

SEQ ID NO: 1975 - protein, 7 aa, synthetic construct
  REGION 1..7: note = n-mer motif
HADVGMS

SEQ ID NO: 1976 - protein, 7 aa, synthetic construct
  REGION 1..7: note = n-mer motif
AGGLLSR

SEQ ID NO: 1977 - protein, 7 aa, synthetic construct
  REGION 1..7: note = n-mer motif
HLSQANH

SEQ ID NO: 1978 - protein, 7 aa, synthetic construct
  REGION 1..7: note = n-mer motif
VHNPTTT

SEQ ID NO: 1979 - protein, 7 aa, synthetic construct
  REGION 1..7: note = n-mer motif
SQRNPDD

SEQ ID NO: 1980 - protein, 7 aa, synthetic construct
  REGION 1..7: note = n-mer motif
RETNNFA

SEQ ID NO: 1981 - protein, 7 aa, synthetic construct
  REGION 1..7: note = n-mer motif
NAGALMG

SEQ ID NO: 1982 - protein, 7 aa, synthetic construct
  REGION 1..7: note = n-mer motif
LPKTVNM

SEQ ID NO: 1983 - protein, 7 aa, synthetic construct
  REGION 1..7: note = n-mer motif
ASDLQMT

SEQ ID NO: 1984 - protein, 7 aa, synthetic construct
  REGION 1..7: note = n-mer motif
QALATTN

SEQ ID NO: 1985 - protein, 7 aa, synthetic construct
  REGION 1..7: note = n-mer motif
HESSGYH

SEQ ID NO: 1986 - protein, 7 aa, synthetic construct
  REGION 1..7: note = n-mer motif
GVNDRAR

SEQ ID NO: 1987 - protein, 7 aa, synthetic construct
  REGION 1..7: note = n-mer motif
PRDALRT

SEQ ID NO: 1988 - protein, 7 aa, synthetic construct
  REGION 1..7: note = n-mer motif
NDSSSMS

SEQ ID NO: 1989 - protein, 7 aa, synthetic construct
  REGION 1..7: note = n-mer motif
EYNTRHD

SEQ ID NO: 1990 - protein, 7 aa, synthetic construct
  REGION 1..7: note = n-mer motif
ASPAHTS

SEQ ID NO: 1991 - protein, 7 aa, synthetic construct
  REGION 1..7: note = n-mer motif
QNSNTPS

SEQ ID NO: 1992 - protein, 7 aa, synthetic construct
  REGION 1..7: note = n-mer motif
LAKLGNY

SEQ ID NO: 1993 - protein, 7 aa, synthetic construct
  REGION 1..7: note = n-mer motif
ASDRQSG

SEQ ID NO: 1994 - protein, 7 aa, synthetic construct
  REGION 1..7: note = n-mer motif
YQNGVLP

SEQ ID NO: 1995 - protein, 7 aa, synthetic construct
  REGION 1..7: note = n-mer motif
NKFGYNP

SEQ ID NO: 1996 - protein, 7 aa, synthetic construct
  REGION 1..7: note = n-mer motif
KKTNGIP

SEQ ID NO: 1997 - protein, 7 aa, synthetic construct
  REGION 1..7: note = n-mer motif
VNDNRGN

SEQ ID NO: 1998 - protein, 7 aa, synthetic construct
  REGION 1..7: note = n-mer motif
MHTITGS

SEQ ID NO: 1999 - protein, 7 aa, synthetic construct
  REGION 1..7: note = n-mer motif
IDGVQKL

SEQ ID NO: 2000 - protein, 7 aa, synthetic construct
  REGION 1..7: note = n-mer motif
AQVNNHD

SEQ ID NO: 2001 - protein, 7 aa, synthetic construct
  REGION 1..7: note = n-mer motif
VSSPNGT

SEQ ID NO: 2002 - protein, 7 aa, synthetic construct
  REGION 1..7: note = n-mer motif
DSAPRAI

SEQ ID NO: 2003 - protein, 7 aa, synthetic construct
  REGION 1..7: note = n-mer motif
SASDSQH

SEQ ID NO: 2004 - protein, 7 aa, synthetic construct
  REGION 1..7: note = n-mer motif
SAHQTPT

SEQ ID NO: 2005 - protein, 7 aa, synthetic construct
  REGION 1..7: note = n-mer motif
ATLNNSY

SEQ ID NO: 2006 - protein, 7 aa, synthetic construct
  REGION 1..7: note = n-mer motif
EDSMRFS

SEQ ID NO: 2007 - protein, 7 aa, synthetic construct
  REGION 1..7: note = n-mer motif
ERNGLIE

SEQ ID NO: 2008 - protein, 7 aa, synthetic construct
  REGION 1..7: note = n-mer motif
LVLDSRN

SEQ ID NO: 2009 - protein, 7 aa, synthetic construct
  REGION 1..7: note = n-mer motif
TVEQINS

SEQ ID NO: 2010 - protein, 7 aa, synthetic construct
  REGION 1..7: note = n-mer motif
GTGTVGW

SEQ ID NO: 2011 - protein, 7 aa, synthetic construct
  REGION 1..7: note = n-mer motif
NQQRIDN

SEQ ID NO: 2012 - protein, 7 aa, synthetic construct
  REGION 1..7: note = n-mer motif
IQNGVLP

SEQ ID NO: 2013 - protein, 7 aa, synthetic construct
  REGION 1..7: note = n-mer motif
GDISSRN

SEQ ID NO: 2014 - protein, 7 aa, synthetic construct
  REGION 1..7: note = n-mer motif
VTGTTPG

SEQ ID NO: 2015 - protein, 7 aa, synthetic construct
  REGION 1..7: note = n-mer motif
TRESMSI

SEQ ID NO: 2016 - protein, 7 aa, synthetic construct
  REGION 1..7: note = n-mer motif
HTYSQAD

SEQ ID NO: 2017 - protein, 7 aa, synthetic construct
  REGION 1..7: note = n-mer motif
SNMGVAS

SEQ ID NO: 2018 - protein, 7 aa, synthetic construct
  REGION 1..7: note = n-mer motif
HDLNHGK

SEQ ID NO: 2019 - protein, 7 aa, synthetic construct
  REGION 1..7: note = n-mer motif
LYGGAHQ

SEQ ID NO: 2020 - protein, 7 aa, synthetic construct
  REGION 1..7: note = n-mer motif
NVYGDGI

SEQ ID NO: 2021 - protein, 7 aa, synthetic construct
  REGION 1..7: note = n-mer motif
STINMRA

SEQ ID NO: 2022 - protein, 7 aa, synthetic construct
  REGION 1..7: note = n-mer motif
KMGSIEV

SEQ ID NO: 2023 - protein, 7 aa, synthetic construct
  REGION 1..7: note = n-mer motif
SETRAGY

SEQ ID NO: 2024 - protein, 7 aa, synthetic construct
  REGION 1..7: note = n-mer motif
NVGNTLG

SEQ ID NO: 2025 - protein, 7 aa, synthetic construct
  REGION 1..7: note = n-mer motif
IGGTDTR

SEQ ID NO: 2026 - protein, 7 aa, synthetic construct
  REGION 1..7: note = n-mer motif
ADKGFGH

SEQ ID NO: 2027 - protein, 7 aa, synthetic construct
  REGION 1..7: note = n-mer motif
WQDHNKV

SEQ ID NO: 2028 - protein, 7 aa, synthetic construct
  REGION 1..7: note = n-mer motif
NYGSGRI

SEQ ID NO: 2029 - protein, 7 aa, synthetic construct
  REGION 1..7: note = n-mer motif
THKQVDL

SEQ ID NO: 2030 - protein, 7 aa, synthetic construct
  REGION 1..7: note = n-mer motif
RQNDKGN

SEQ ID NO: 2031 - protein, 7 aa, synthetic construct
  REGION 1..7: note = n-mer motif
GRNESPE

SEQ ID NO: 2032 - protein, 7 aa, synthetic construct
  REGION 1..7: note = n-mer motif
VFTGQTE

SEQ ID NO: 2033 - protein, 7 aa, synthetic construct
  REGION 1..7: note = n-mer motif
YVDRKDN

SEQ ID NO: 2034 - protein, 7 aa, synthetic construct
  REGION 1..7: note = n-mer motif
NNTLNIL

SEQ ID NO: 2035 - protein, 7 aa, synthetic construct
  REGION 1..7: note = n-mer motif
LSYSIQH

SEQ ID NO: 2036 - protein, 7 aa, synthetic construct
  REGION 1..7: note = n-mer motif
ATNRSPL

SEQ ID NO: 2037 - protein, 7 aa, synthetic construct
  REGION 1..7: note = n-mer motif
VHTADTI

SEQ ID NO: 2038 - protein, 7 aa, synthetic construct
  REGION 1..7: note = n-mer motif
GHLVNMS

SEQ ID NO: 2039 - protein, 7 aa, synthetic construct
  REGION 1..7: note = n-mer motif
LDYTPQN

SEQ ID NO: 2040 - protein, 7 aa, synthetic construct
  REGION 1..7: note = n-mer motif
SASYSRM

SEQ ID NO: 2041 - protein, 7 aa, synthetic construct
  REGION 1..7: note = n-mer motif
SGAAQNP

SEQ ID NO: 2042 - protein, 7 aa, synthetic construct
  REGION 1..7: note = n-mer motif
RNTLADL

SEQ ID NO: 2043 - protein, 7 aa, synthetic construct
  REGION 1..7: note = n-mer motif
GSTVSAQ

SEQ ID NO: 2044 - protein, 7 aa, synthetic construct
  REGION 1..7: note = n-mer motif
SKDSTMY

SEQ ID NO: 2045 - protein, 7 aa, synthetic construct
  REGION 1..7: note = n-mer motif
VVVHTIP

SEQ ID NO: 2046 - protein, 7 aa, synthetic construct
  REGION 1..7: note = n-mer motif
PRTVSLD

SEQ ID NO: 2047 - protein, 7 aa, synthetic construct
  REGION 1..7: note = n-mer motif
MMKSEEN

SEQ ID NO: 2048 - protein, 7 aa, synthetic construct
  REGION 1..7: note = n-mer motif
TTDRPNG

SEQ ID NO: 2049 - protein, 7 aa, synthetic construct
  REGION 1..7: note = n-mer motif
HSPPTTM

SEQ ID NO: 2050 - protein, 7 aa, synthetic construct
  REGION 1..7: note = n-mer motif
GQWTTGT

SEQ ID NO: 2051 - protein, 7 aa, synthetic construct
  REGION 1..7: note = n-mer motif
DGMNGVG

SEQ ID NO: 2052 - protein, 7 aa, synthetic construct
  REGION 1..7: note = n-mer motif
LHTVANE

SEQ ID NO: 2053 - protein, 7 aa, synthetic construct
  REGION 1..7: note = n-mer motif
YTSQTST

SEQ ID NO: 2054 - protein, 7 aa, synthetic construct
  REGION 1..7: note = n-mer motif
NFSEMST

SEQ ID NO: 2055 - protein, 7 aa, synthetic construct
  REGION 1..7: note = n-mer motif
INIRSDL

SEQ ID NO: 2056 - protein, 7 aa, synthetic construct
  REGION 1..7: note = n-mer motif
PSNSERF

SEQ ID NO: 2057 - protein, 7 aa, synthetic construct
  REGION 1..7: note = n-mer motif
YTNYGDL

SEQ ID NO: 2058 - protein, 7 aa, synthetic construct
  REGION 1..7: note = n-mer motif
DKSTAQA

SEQ ID NO: 2059 - protein, 7 aa, synthetic construct
  REGION 1..7: note = n-mer motif
HTDMVSS

SEQ ID NO: 2060 - protein, 7 aa, synthetic construct
  REGION 1..7: note = n-mer motif
NKSLSMD

SEQ ID NO: 2061 - protein, 7 aa, synthetic construct
  REGION 1..7: note = n-mer motif
GHYATNT

SEQ ID NO: 2062 - protein, 7 aa, synthetic construct
  REGION 1..7: note = n-mer motif
VIVSTKS

SEQ ID NO: 2063 - protein, 7 aa, synthetic construct
  REGION 1..7: note = n-mer motif
THSLMND

SEQ ID NO: 2064 - protein, 7 aa, synthetic construct
  REGION 1..7: note = n-mer motif
NYHGDNV

SEQ ID NO: 2065 - protein, 7 aa, synthetic construct
  REGION 1..7: note = n-mer motif
RDDQQLD

SEQ ID NO: 2066 - protein, 7 aa, synthetic construct
  REGION 1..7: note = n-mer motif
DDKTGRY

SEQ ID NO: 2067 - protein, 7 aa, synthetic construct
  REGION 1..7: note = n-mer motif
GSSQHHE

SEQ ID NO: 2068 - protein, 7 aa, synthetic construct
  REGION 1..7: note = n-mer motif
RVTGVST

SEQ ID NO: 2069 - protein, 7 aa, synthetic construct
  REGION 1..7: note = n-mer motif
STASGHT

SEQ ID NO: 2070 - protein, 7 aa, synthetic construct
  REGION 1..7: note = n-mer motif
TNNLSYE

SEQ ID NO: 2071 - protein, 7 aa, synthetic construct
  REGION 1..7: note = n-mer motif
QHNSASA

SEQ ID NO: 2072 - protein, 7 aa, synthetic construct
  REGION 1..7: note = n-mer motif
PAKGFGH

SEQ ID NO: 2073 - protein, 7 aa, synthetic construct
  REGION 1..7: note = n-mer motif
WYETISP

SEQ ID NO: 2074 - protein, 7 aa, synthetic construct
  REGION 1..7: note = n-mer motif
TDATGRH

SEQ ID NO: 2075 - protein, 7 aa, synthetic construct
  REGION 1..7: note = n-mer motif
IQAKNSE

SEQ ID NO: 2076 - protein, 7 aa, synthetic construct
  REGION 1..7: note = n-mer motif
STETRGG

SEQ ID NO: 2077 - protein, 7 aa, synthetic construct
  REGION 1..7: note = n-mer motif
FSTNSVI

SEQ ID NO: 2078 - protein, 7 aa, synthetic construct
  REGION 1..7: note = n-mer motif
SNLRNTI

SEQ ID NO: 2079 - protein, 7 aa, synthetic construct
  REGION 1..7: note = n-mer motif
GMIGHNA

SEQ ID NO: 2080 - protein, 7 aa, synthetic construct
  REGION 1..7: note = n-mer motif
SGQGFSA

SEQ ID NO: 2081 - protein, 7 aa, synthetic construct
  REGION 1..7: note = n-mer motif
THNSTGL

SEQ ID NO: 2082 - protein, 7 aa, synthetic construct
  REGION 1..7: note = n-mer motif
RIDSAMV

SEQ ID NO: 2083 - protein, 7 aa, synthetic construct
  REGION 1..7: note = n-mer motif
VAMGGGP

SEQ ID NO: 2084 - protein, 7 aa, synthetic construct
  REGION 1..7: note = n-mer motif
GSHNGPA

SEQ ID NO: 2085 - protein, 7 aa, synthetic construct
  REGION 1..7: note = n-mer motif
HSAAGDG

SEQ ID NO: 2086 - protein, 7 aa, synthetic construct
  REGION 1..7: note = n-mer motif
AQGITHA

SEQ ID NO: 2087 - protein, 7 aa, synthetic construct
  REGION 1..7: note = n-mer motif
SALLRMD

SEQ ID NO: 2088 - protein, 7 aa, synthetic construct
  REGION 1..7: note = n-mer motif
WQMGAGS

SEQ ID NO: 2089 - protein, 7 aa, synthetic construct
  REGION 1..7: note = n-mer motif
IDSHASI

SEQ ID NO: 2090 - protein, 7 aa, synthetic construct
  REGION 1..7: note = n-mer motif
SLDHAPL

SEQ ID NO: 2091 - protein, 7 aa, synthetic construct
  REGION 1..7: note = n-mer motif
ENNMQHG

SEQ ID NO: 2092 - protein, 7 aa, synthetic construct
  REGION 1..7: note = n-mer motif
KGAQGVQ

SEQ ID NO: 2093 - protein, 7 aa, synthetic construct
  REGION 1..7: note = n-mer motif
VAVSNTP

SEQ ID NO: 2094 - protein, 7 aa, synthetic construct
  REGION 1..7: note = n-mer motif
VESSYSR

SEQ ID NO: 2095 - protein, 7 aa, synthetic construct
  REGION 1..7: note = n-mer motif
HNTESKT

SEQ ID NO: 2096 - protein, 7 aa, synthetic construct
  REGION 1..7: note = n-mer motif
NESTKES

SEQ ID NO: 2097 - protein, 7 aa, synthetic construct
  REGION 1..7: note = n-mer motif
DVYLKSP

SEQ ID NO: 2098 - protein, 7 aa, synthetic construct
  REGION 1..7: note = n-mer motif
QSGARTL

SEQ ID NO: 2099 - protein, 7 aa, synthetic construct
  REGION 1..7: note = n-mer motif
SNSQVHN

SEQ ID NO: 2100 - protein, 7 aa, synthetic construct
  REGION 1..7: note = n-mer motif
VVSSGGW

SEQ ID NO: 2101 - protein, 7 aa, synthetic construct
  REGION 1..7: note = n-mer motif
PSSFNSA

SEQ ID NO: 2102 - protein, 7 aa, synthetic construct
  REGION 1..7: note = n-mer motif
KQTDSRG

SEQ ID NO: 2103 - protein, 7 aa, synthetic construct
  REGION 1..7: note = n-mer motif
NTTPPNH

SEQ ID NO: 2104 - protein, 7 aa, synthetic construct
  REGION 1..7: note = n-mer motif
QNGTSSI

SEQ ID NO: 2105 - protein, 7 aa, synthetic construct
  REGION 1..7: note = n-mer motif
LMKDMES

SEQ ID NO: 2106 - protein, 7 aa, synthetic construct
  REGION 1..7: note = n-mer motif
TQTGHVS

SEQ ID NO: 2107 - protein, 7 aa, synthetic construct
  REGION 1..7: note = n-mer motif
EIHTTTG

SEQ ID NO: 2108 - protein, 7 aa, synthetic construct
  REGION 1..7: note = n-mer motif
IQTTTKC

SEQ ID NO: 2109 - protein, 7 aa, synthetic construct
  REGION 1..7: note = n-mer motif
PAEGNNR

SEQ ID NO: 2110 - protein, 7 aa, synthetic construct
  REGION 1..7: note = n-mer motif
YIAGGEQ

SEQ ID NO: 2111 - protein, 7 aa, synthetic construct
  REGION 1..7: note = n-mer motif
EVRDQKT

SEQ ID NO: 2112 - protein, 7 aa, synthetic construct
  REGION 1..7: note = n-mer motif
YAVAIGT

SEQ ID NO: 2113 - protein, 7 aa, synthetic construct
  REGION 1..7: note = n-mer motif
SANEHNH

SEQ ID NO: 2114 - protein, 7 aa, synthetic construct
  REGION 1..7: note = n-mer motif
GMRDTPP

SEQ ID NO: 2115 - protein, 7 aa, synthetic construct
  REGION 1..7: note = n-mer motif
AQQIVNG

SEQ ID NO: 2116 - protein, 7 aa, synthetic construct
  REGION 1..7: note = n-mer motif
SSSQTVL

SEQ ID NO: 2117 - protein, 7 aa, synthetic construct
  REGION 1..7: note = n-mer motif
VIQSDNT

SEQ ID NO: 2118 - protein, 7 aa, synthetic construct
  REGION 1..7: note = n-mer motif
VPAHSRG

SEQ ID NO: 2119 - protein, 7 aa, synthetic construct
  REGION 1..7: note = n-mer motif
SNTGSLG

SEQ ID NO: 2120 - protein, 7 aa, synthetic construct
  REGION 1..7: note = n-mer motif
WAKDVNV

SEQ ID NO: 2121 - protein, 7 aa, synthetic construct
  REGION 1..7: note = n-mer motif
NVLGASS

SEQ ID NO: 2122 - protein, 7 aa, synthetic construct
  REGION 1..7: note = n-mer motif
TPEASAR

SEQ ID NO: 2123 - protein, 7 aa, synthetic construct
  REGION 1..7: note = n-mer motif
NYNGVNV

SEQ ID NO: 2124 - protein, 7 aa, synthetic construct
  REGION 1..7: note = n-mer motif
NTTGSSG

SEQ ID NO: 2125 - protein, 7 aa, synthetic construct
  REGION 1..7: note = n-mer motif
SSGQPLV

SEQ ID NO: 2126 - protein, 7 aa, synthetic construct
  REGION 1..7: note = n-mer motif
QAGGVAS

SEQ ID NO: 2127 - protein, 7 aa, synthetic construct
  REGION 1..7: note = n-mer motif
PLQSQSG

SEQ ID NO: 2128 - protein, 7 aa, synthetic construct
  REGION 1..7: note = n-mer motif
QRTSEAP

SEQ ID NO: 2129 - protein, 7 aa, synthetic construct
  REGION 1..7: note = n-mer motif
LAKTVAI

SEQ ID NO: 2130 - protein, 7 aa, synthetic construct
  REGION 1..7: note = n-mer motif
THTLGGT

SEQ ID NO: 2131 - protein, 7 aa, synthetic construct
  REGION 1..7: note = n-mer motif
HDYSMNA

SEQ ID NO: 2132 - protein, 7 aa, synthetic construct
  REGION 1..7: note = n-mer motif
GKPAEAP

SEQ ID NO: 2133 - protein, 7 aa, synthetic construct
  REGION 1..7: note = n-mer motif
RNENVNA

SEQ ID NO: 2134 - protein, 7 aa, synthetic construct
  REGION 1..7: note = n-mer motif
SSREAKF

SEQ ID NO: 2135 - protein, 7 aa, synthetic construct
  REGION 1..7: note = n-mer motif
SSSDSPR

SEQ ID NO: 2136 - protein, 7 aa, synthetic construct
  REGION 1..7: note = n-mer motif
MNTTYNE

SEQ ID NO: 2137 - protein, 7 aa, synthetic construct
  REGION 1..7: note = n-mer motif
VRSGIKP

SEQ ID NO: 2138 - protein, 7 aa, synthetic construct
  REGION 1..7: note = n-mer motif
QENPMKM

SEQ ID NO: 2139 - protein, 7 aa, synthetic construct
  REGION 1..7: note = n-mer motif
TEPLPMS

SEQ ID NO: 2140 - protein, 7 aa, synthetic construct
  REGION 1..7: note = n-mer motif
RHGDTPM

SEQ ID NO: 2141 - protein, 7 aa, synthetic construct
  REGION 1..7: note = n-mer motif
AVNTYNS

SEQ ID NO: 2142 - protein, 7 aa, synthetic construct
  REGION 1..7: note = n-mer motif
ASTESHV

SEQ ID NO: 2143 - protein, 7 aa, synthetic construct
  REGION 1..7: note = n-mer motif
TNLSQSA

SEQ ID NO: 2144 - protein, 7 aa, synthetic construct
  REGION 1..7: note = n-mer motif
ELSTPMV

SEQ ID NO: 2145 - protein, 7 aa, synthetic construct
  REGION 1..7: note = n-mer motif
YAHPVTH

SEQ ID NO: 2146 - protein, 7 aa, synthetic construct
  REGION 1..7: note = n-mer motif
RGSTGTQ

SEQ ID NO: 2147 - protein, 7 aa, synthetic construct
  REGION 1..7: note = n-mer motif
CVGSCGV

SEQ ID NO: 2148 - protein, 7 aa, synthetic construct
  REGION 1..7: note = n-mer motif
SVAKDQT

SEQ ID NO: 2149 - protein, 7 aa, synthetic construct
  REGION 1..7: note = n-mer motif
TNLSPKT

SEQ ID NO: 2150 - protein, 7 aa, synthetic construct
  REGION 1..7: note = n-mer motif
LGFTPQP

SEQ ID NO: 2151 - protein, 7 aa, synthetic construct
  REGION 1..7: note = n-mer motif
NISSINQ

SEQ ID NO: 2152 - protein, 7 aa, synthetic construct
  REGION 1..7: note = n-mer motif
VYDNVSS

SEQ ID NO: 2153 - protein, 7 aa, synthetic construct
  REGION 1..7: note = n-mer motif
SGKQDKY

SEQ ID NO: 2154 - protein, 7 aa, synthetic construct
  REGION 1..7: note = n-mer motif
RLTELVI

SEQ ID NO: 2155 - protein, 7 aa, synthetic construct
  REGION 1..7: note = n-mer motif
HKSESHN

SEQ ID NO: 2156 - protein, 7 aa, synthetic construct
  REGION 1..7: note = n-mer motif
EATHGSY

SEQ ID NO: 2157 - protein, 7 aa, synthetic construct
  REGION 1..7: note = n-mer motif
NLLVDQR

SEQ ID NO: 2158 - protein, 7 aa, synthetic construct
  REGION 1..7: note = n-mer motif
NINDTKN

SEQ ID NO: 2159 - protein, 7 aa, synthetic construct
  REGION 1..7: note = n-mer motif
LAVTNVR

SEQ ID NO: 2160 - protein, 7 aa, synthetic construct
  REGION 1..7: note = n-mer motif
PSTLAET

SEQ ID NO: 2161 - protein, 7 aa, synthetic construct
  REGION 1..7: note = n-mer motif
PKPGTGE

SEQ ID NO: 2162 - protein, 7 aa, synthetic construct
  REGION 1..7: note = n-mer motif
VLLQNSH

SEQ ID NO: 2163 - protein, 7 aa, synthetic construct
  REGION 1..7: note = n-mer motif
YGNANTV

SEQ ID NO: 2164 - protein, 7 aa, synthetic construct
  REGION 1..7: note = n-mer motif
TSGVLTR

SEQ ID NO: 2165 - protein, 7 aa, synthetic construct
  REGION 1..7: note = n-mer motif
KITETNL

SEQ ID NO: 2166 - protein, 7 aa, synthetic construct
  REGION 1..7: note = n-mer motif
VRRDETP

SEQ ID NO: 2167 - protein, 7 aa, synthetic construct
  REGION 1..7: note = n-mer motif
SKMSNPV

SEQ ID NO: 2168 - protein, 7 aa, synthetic construct
  REGION 1..7: note = n-mer motif
WESLSNA

SEQ ID NO: 2169 - protein, 7 aa, synthetic construct
  REGION 1..7: note = n-mer motif
ANGGGYP

SEQ ID NO: 2170 - protein, 7 aa, synthetic construct
  REGION 1..7: note = n-mer motif
MLASRVP

SEQ ID NO: 2171 - protein, 7 aa, synthetic construct
  REGION 1..7: note = n-mer motif
CGLNCGK

SEQ ID NO: 2172 - protein, 7 aa, synthetic construct
  REGION 1..7: note = n-mer motif
TITSPSV

SEQ ID NO: 2173 - protein, 7 aa, synthetic construct
  REGION 1..7: note = n-mer motif
WSNAQSP

SEQ ID NO: 2174 - protein, 7 aa, synthetic construct
  REGION 1..7: note = n-mer motif
TESPKLL

SEQ ID NO: 2175 - protein, 7 aa, synthetic construct
  REGION 1..7: note = n-mer motif
HLVTSGI

SEQ ID NO: 2176 - protein, 7 aa, synthetic construct
  REGION 1..7: note = n-mer motif
PPKSDSN

SEQ ID NO: 2177 - protein, 7 aa, synthetic construct
  REGION 1..7: note = n-mer motif
IAVHVLS

SEQ ID NO: 2178 - protein, 7 aa, synthetic construct
  REGION 1..7: note = n-mer motif
TGTATLP

SEQ ID NO: 2179 - protein, 7 aa, synthetic construct
  REGION 1..7: note = n-mer motif
NTTPPNH

SEQ ID NO: 2180 - protein, 7 aa, synthetic construct
  REGION 1..7: note = n-mer motif
CTATKCS

SEQ ID NO: 2181 - protein, 7 aa, synthetic construct
  REGION 1..7: note = n-mer motif
HSDMVSG

SEQ ID NO: 2182 - protein, 7 aa, synthetic construct
  REGION 1..7: note = n-mer motif
PNAHHLP

SEQ ID NO: 2183 - protein, 7 aa, synthetic construct
  REGION 1..7: note = n-mer motif
SNNMNQA

SEQ ID NO: 2184 - protein, 7 aa, synthetic construct
  REGION 1..7: note = n-mer motif
SDNNRAN

SEQ ID NO: 2185 - protein, 7 aa, synthetic construct
  REGION 1..7: note = n-mer motif
LQTPGTT

SEQ ID NO: 2186 - protein, 7 aa, synthetic construct
  REGION 1..7: note = n-mer motif
VRGVQDA

SEQ ID NO: 2187 - protein, 7 aa, synthetic construct
  REGION 1..7: note = n-mer motif
SLDSRSS

SEQ ID NO: 2188 - protein, 7 aa, synthetic construct
  REGION 1..7: note = n-mer motif
VCVTTCA

SEQ ID NO: 2189 - protein, 7 aa, synthetic construct
  REGION 1..7: note = n-mer motif
PNTNHLV

SEQ ID NO: 2190 - protein, 7 aa, synthetic construct
  REGION 1..7: note = n-mer motif
LMSGKEN

SEQ ID NO: 2191 - protein, 7 aa, synthetic construct
  REGION 1..7: note = n-mer motif
TSASENW

SEQ ID NO: 2192 - protein, 7 aa, synthetic construct
  REGION 1..7: note = n-mer motif
FLPQLGQ

SEQ ID NO: 2193 - protein, 7 aa, synthetic construct
  REGION 1..7: note = n-mer motif
PFNPGNV

SEQ ID NO: 2194 - protein, 7 aa, synthetic construct
  REGION 1..7: note = n-mer motif
GTPGQSI

SEQ ID NO: 2195 - protein, 7 aa, synthetic construct
  REGION 1..7: note = n-mer motif
YNNGGHV

SEQ ID NO: 2196 - protein, 7 aa, synthetic construct
  REGION 1..7: note = n-mer motif
LGNHYTP

SEQ ID NO: 2197 - protein, 7 aa, synthetic construct
  REGION 1..7: note = n-mer motif
QVNQPRI

SEQ ID NO: 2198 - protein, 7 aa, synthetic construct
  REGION 1..7: note = n-mer motif
LGNNRPL

SEQ ID NO: 2199 - protein, 7 aa, synthetic construct
  REGION 1..7: note = n-mer motif
PPESARG

SEQ ID NO: 2200 - protein, 7 aa, synthetic construct
  REGION 1..7: note = n-mer motif
KSVGDGR

SEQ ID NO: 2201 - protein, 7 aa, synthetic construct
  REGION 1..7: note = n-mer motif
SLRTDEF

SEQ ID NO: 2202 - protein, 7 aa, synthetic construct
  REGION 1..7: note = n-mer motif
STTNVAY

SEQ ID NO: 2203 - protein, 7 aa, synthetic construct
  REGION 1..7: note = n-mer motif
RMSDPSD

SEQ ID NO: 2204 - protein, 7 aa, synthetic construct
  REGION 1..7: note = n-mer motif
SLSITSA

SEQ ID NO: 2205 - protein, 7 aa, synthetic construct
  REGION 1..7: note = n-mer motif
ESATSLK

SEQ ID NO: 2206 - protein, 7 aa, synthetic construct
  REGION 1..7: note = n-mer motif
YTDGRNT

SEQ ID NO: 2207 - protein, 7 aa, synthetic construct
  REGION 1..7: note = n-mer motif
SISNLRT

SEQ ID NO: 2208 - protein, 7 aa, synthetic construct
  REGION 1..7: note = n-mer motif
QNDKSDN

SEQ ID NO: 2209 - protein, 7 aa, synthetic construct
  REGION 1..7: note = n-mer motif
GGTGLSK

SEQ ID NO: 2210 - protein, 7 aa, synthetic construct
  REGION 1..7: note = n-mer motif
SQAQIRV

SEQ ID NO: 2211 - protein, 7 aa, synthetic construct
  REGION 1..7: note = n-mer motif
GLMAHVT

SEQ ID NO: 2212 - protein, 7 aa, synthetic construct
  REGION 1..7: note = n-mer motif
LVVSNSL

SEQ ID NO: 2213 - protein, 7 aa, synthetic construct
  REGION 1..7: note = n-mer motif
HDSVNTA

SEQ ID NO: 2214 - protein, 7 aa, synthetic construct
  REGION 1..7: note = n-mer motif
TLAKDGN

SEQ ID NO: 2215 - protein, 7 aa, synthetic construct
  REGION 1..7: note = n-mer motif
SDGSKLL

SEQ ID NO: 2216 - protein, 7 aa, synthetic construct
  REGION 1..7: note = n-mer motif
IDKTFSV

SEQ ID NO: 2217 - protein, 7 aa, synthetic construct
  REGION 1..7: note = n-mer motif
RLVNIDH

SEQ ID NO: 2218 - protein, 7 aa, synthetic construct
  REGION 1..7: note = n-mer motif
KNYDSDS

SEQ ID NO: 2219 - protein, 7 aa, synthetic construct
  REGION 1..7: note = n-mer motif
STQSTNP

SEQ ID NO: 2220 - protein, 7 aa, synthetic construct
  REGION 1..7: note = n-mer motif
QISLQLG

SEQ ID NO: 2221 - protein, 7 aa, synthetic construct
  REGION 1..7: note = n-mer motif
SEPLRVG

SEQ ID NO: 2222 - protein, 7 aa, synthetic construct
  REGION 1..7: note = n-mer motif
SRLQTQQ

SEQ ID NO: 2223 - protein, 7 aa, synthetic construct
  REGION 1..7: note = n-mer motif
EGSQGNH

SEQ ID NO: 2224 - protein, 7 aa, synthetic construct
  REGION 1..7: note = n-mer motif
RSDLTES

SEQ ID NO: 2225 - protein, 7 aa, synthetic construct
  REGION 1..7: note = n-mer motif
HTGVQTN

SEQ ID NO: 2226 - protein, 7 aa, synthetic construct
  REGION 1..7: note = n-mer motif
ELDHLSH

SEQ ID NO: 2227 - protein, 7 aa, synthetic construct
  REGION 1..7: note = n-mer motif
VTGVDYA

SEQ ID NO: 2228 - protein, 7 aa, synthetic construct
  REGION 1..7: note = n-mer motif
GGAHTRV

SEQ ID NO: 2229 - protein, 7 aa, synthetic construct
  REGION 1..7: note = n-mer motif
AYGIHEV

SEQ ID NO: 2230 - protein, 7 aa, synthetic construct
  REGION 1..7: note = n-mer motif
AMLRMEQ

SEQ ID NO: 2231 - protein, 7 aa, synthetic construct
  REGION 1..7: note = n-mer motif
RQANQTY

SEQ ID NO: 2232 - protein, 7 aa, synthetic construct
  REGION 1..7: note = n-mer motif
FSGQALA

SEQ ID NO: 2233 - protein, 7 aa, synthetic construct
  REGION 1..7: note = n-mer motif
DNVNSQP

SEQ ID NO: 2234 - protein, 7 aa, synthetic construct
  REGION 1..7: note = n-mer motif
GLHGTSN

SEQ ID NO: 2235 - protein, 7 aa, synthetic construct
  REGION 1..7: note = n-mer motif
EREPPKN

SEQ ID NO: 2236 - protein, 7 aa, synthetic construct
  REGION 1..7: note = n-mer motif
VVTLGML

SEQ ID NO: 2237 - protein, 7 aa, synthetic construct
  REGION 1..7: note = n-mer motif
HNNNLLN

SEQ ID NO: 2238 - protein, 7 aa, synthetic construct
  REGION 1..7: note = n-mer motif
LINMSQN

SEQ ID NO: 2239 - protein, 7 aa, synthetic construct
  REGION 1..7: note = n-mer motif
NTNASYS

SEQ ID NO: 2240 - protein, 7 aa, synthetic construct
  REGION 1..7: note = n-mer motif
RLNAGEH

SEQ ID NO: 2241 - protein, 7 aa, synthetic construct
  REGION 1..7: note = n-mer motif
AVILNPV

SEQ ID NO: 2242 - protein, 7 aa, synthetic construct
  REGION 1..7: note = n-mer motif
PSTHGYV

SEQ ID NO: 2243 - protein, 7 aa, synthetic construct
  REGION 1..7: note = n-mer motif
LRASVSE

SEQ ID NO: 2244 - protein, 7 aa, synthetic construct
  REGION 1..7: note = n-mer motif
MMTSMTL

SEQ ID NO: 2245 - protein, 7 aa, synthetic construct
  REGION 1..7: note = n-mer motif
SAHNIVY

SEQ ID NO: 2246 - protein, 7 aa, synthetic construct
  REGION 1..7: note = n-mer motif
HDSTTRP

SEQ ID NO: 2247 - protein, 7 aa, synthetic construct
  REGION 1..7: note = n-mer motif
IKDSYLT

SEQ ID NO: 2248 - protein, 7 aa, synthetic construct
  REGION 1..7: note = n-mer motif
YTPGLTE

SEQ ID NO: 2249 - protein, 7 aa, synthetic construct
  REGION 1..7: note = n-mer motif
KMGGSQS

SEQ ID NO: 2250 - protein, 7 aa, synthetic construct
  REGION 1..7: note = n-mer motif
SRQTALT

SEQ ID NO: 2251 - protein, 7 aa, synthetic construct
  REGION 1..7: note = n-mer motif
VETSRLY

SEQ ID NO: 2252 - protein, 7 aa, synthetic construct
  REGION 1..7: note = n-mer motif
KSNNGEY

SEQ ID NO: 2253 - protein, 7 aa, synthetic construct
  REGION 1..7: note = n-mer motif
SGVHSAR

SEQ ID NO: 2254 - protein, 7 aa, synthetic construct
  REGION 1..7: note = n-mer motif
PNNEKNP

SEQ ID NO: 2255 - protein, 7 aa, synthetic construct
  REGION 1..7: note = n-mer motif
TIGEGYH

SEQ ID NO: 2256 - protein, 7 aa, synthetic construct
  REGION 1..7: note = n-mer motif
LQTSVAT

SEQ ID NO: 2257 - protein, 7 aa, synthetic construct
  REGION 1..7: note = n-mer motif
LLGNAPT

SEQ ID NO: 2258 - protein, 7 aa, synthetic construct
  REGION 1..7: note = n-mer motif
ISGSHLN

SEQ ID NO: 2259 - protein, 7 aa, synthetic construct
  REGION 1..7: note = n-mer motif
KSLSSDD

SEQ ID NO: 2260 - protein, 7 aa, synthetic construct
  REGION 1..7: note = n-mer motif
TRTQGTS

SEQ ID NO: 2261 - protein, 7 aa, synthetic construct
  REGION 1..7: note = n-mer motif
VSRSGST

SEQ ID NO: 2262 - protein, 7 aa, synthetic construct
  REGION 1..7: note = n-mer motif
SADTRSP

SEQ ID NO: 2263 - protein, 7 aa, synthetic construct
  REGION 1..7: note = n-mer motif
RDTANGP

SEQ ID NO: 2264 - protein, 7 aa, synthetic construct
  REGION 1..7: note = n-mer motif
MMSNSLA

SEQ ID NO: 2265 - protein, 7 aa, synthetic construct
  REGION 1..7: note = n-mer motif
TGRIELR

SEQ ID NO: 2266 - protein, 7 aa, synthetic construct
  REGION 1..7: note = n-mer motif
ANNAAAS

SEQ ID NO: 2267 - protein, 7 aa, synthetic construct
  REGION 1..7: note = n-mer motif
QLNINDK

SEQ ID NO: 2268 - protein, 7 aa, synthetic construct
  REGION 1..7: note = n-mer motif
MDGAHTS

SEQ ID NO: 2269 - protein, 7 aa, synthetic construct
  REGION 1..7: note = n-mer motif
TSATDSM

SEQ ID NO: 2270 - protein, 7 aa, synthetic construct
  REGION 1..7: note = n-mer motif
AASLSQS

SEQ ID NO: 2271 - protein, 7 aa, synthetic construct
  REGION 1..7: note = n-mer motif
SQAGLLV

SEQ ID NO: 2272 - protein, 7 aa, synthetic construct
  REGION 1..7: note = n-mer motif
TTYSDLS

SEQ ID NO: 2273 - protein, 7 aa, synthetic construct
  REGION 1..7: note = n-mer motif
FSSGTTI

SEQ ID NO: 2274 - protein, 7 aa, synthetic construct
  REGION 1..7: note = n-mer motif
VFTEIES

SEQ ID NO: 2275 - protein, 7 aa, synthetic construct
  REGION 1..7: note = n-mer motif
ADPAKGK

SEQ ID NO: 2276 - protein, 7 aa, synthetic construct
  REGION 1..7: note = n-mer motif
KESEYRV

SEQ ID NO: 2277 - protein, 7 aa, synthetic construct
  REGION 1..7: note = n-mer motif
GMVSLNR

SEQ ID NO: 2278 - protein, 7 aa, synthetic construct
  REGION 1..7: note = n-mer motif
TVIERKD

SEQ ID NO: 2279 - protein, 7 aa, synthetic construct
  REGION 1..7: note = n-mer motif
RIDTLLV

SEQ ID NO: 2280 - protein, 7 aa, synthetic construct
  REGION 1..7: note = n-mer motif
GSTGLPP

SEQ ID NO: 2281 - protein, 7 aa, synthetic construct
  REGION 1..7: note = n-mer motif
MELTSTS

SEQ ID NO: 2282 - protein, 7 aa, synthetic construct
  REGION 1..7: note = n-mer motif
QPGAPQT

SEQ ID NO: 2283 - protein, 7 aa, synthetic construct
  REGION 1..7: note = n-mer motif
NSMGNGG

SEQ ID NO: 2284 - protein, 7 aa, synthetic construct
  REGION 1..7: note = n-mer motif
GSTKSGQ

SEQ ID NO: 2285 - protein, 7 aa, synthetic construct
  REGION 1..7: note = n-mer motif
TFLPQLG

SEQ ID NO: 2286 - protein, 7 aa, synthetic construct
  REGION 1..7: note = n-mer motif
MGINVLS

SEQ ID NO: 2287 - protein, 7 aa, synthetic construct
  REGION 1..7: note = n-mer motif
VNLGISG

SEQ ID NO: 2288 - protein, 7 aa, synthetic construct
  REGION 1..7: note = n-mer motif
SENRAGN

SEQ ID NO: 2289 - protein, 7 aa, synthetic construct
  REGION 1..7: note = n-mer motif
HSNATTI

SEQ ID NO: 2290 - protein, 7 aa, synthetic construct
  REGION 1..7: note = n-mer motif
PGSSASI

SEQ ID NO: 2291 - protein, 7 aa, synthetic construct
  REGION 1..7: note = n-mer motif
ITSLNGM

SEQ ID NO: 2292 - protein, 7 aa, synthetic construct
  REGION 1..7: note = n-mer motif
YLEGAHR

SEQ ID NO: 2293 - protein, 7 aa, synthetic construct
  REGION 1..7: note = n-mer motif
RQVEQSD

SEQ ID NO: 2294 - protein, 7 aa, synthetic construct
  REGION 1..7: note = n-mer motif
SSQSSGS

SEQ ID NO: 2295 - protein, 7 aa, synthetic construct
  REGION 1..7: note = n-mer motif
QLTVGKP

SEQ ID NO: 2296 - protein, 7 aa, synthetic construct
  REGION 1..7: note = n-mer motif
VVHSSIT

SEQ ID NO: 2297 - protein, 7 aa, synthetic construct
  REGION 1..7: note = n-mer motif
LEQLRVP

SEQ ID NO: 2298 - protein, 7 aa, synthetic construct
  REGION 1..7: note = n-mer motif
QHSPKPV

SEQ ID NO: 2299 - protein, 7 aa, synthetic construct
  REGION 1..7: note = n-mer motif
AGSSPSR

SEQ ID NO: 2300 - protein, 7 aa, synthetic construct
  REGION 1..7: note = n-mer motif
GVTIGSR

SEQ ID NO: 2301 - protein, 7 aa, synthetic construct
  REGION 1..7: note = n-mer motif
YIAGGDQ

SEQ ID NO: 2302 - protein, 7 aa, synthetic construct
  REGION 1..7: note = n-mer motif
ISSERFS

SEQ ID NO: 2303 - protein, 7 aa, synthetic construct
  REGION 1..7: note = n-mer motif
RSEGNHA

SEQ ID NO: 2304 - protein, 7 aa, synthetic construct
  REGION 1..7: note = n-mer motif
EKGNSGV

SEQ ID NO: 2305 - protein, 7 aa, synthetic construct
  REGION 1..7: note = n-mer motif
YIVDHAN

SEQ ID NO: 2306 - protein, 7 aa, synthetic construct
  REGION 1..7: note = n-mer motif
RRLSTDL

SEQ ID NO: 2307 - protein, 7 aa, synthetic construct
  REGION 1..7: note = n-mer motif
ANSRLGA

SEQ ID NO: 2308 - protein, 7 aa, synthetic construct
  REGION 1..7: note = n-mer motif
GTAENTS

SEQ ID NO: 2309 - protein, 7 aa, synthetic construct
  REGION 1..7: note = n-mer motif
VRDVAKE

SEQ ID NO: 2310 - protein, 7 aa, synthetic construct
  REGION 1..7: note = n-mer motif
GGLTNGL

SEQ ID NO: 2311 - protein, 7 aa, synthetic construct
  REGION 1..7: note = n-mer motif
PSIPSFS

SEQ ID NO: 2312 - protein, 7 aa, synthetic construct
  REGION 1..7: note = n-mer motif
NALLNAP

SEQ ID NO: 2313 - protein, 7 aa, synthetic construct
  REGION 1..7: note = n-mer motif
DDMVKNS

SEQ ID NO: 2314 - protein, 7 aa, synthetic construct
  REGION 1..7: note = n-mer motif
TANTHAL

SEQ ID NO: 2315 - protein, 7 aa, synthetic construct
  REGION 1..7: note = n-mer motif
VYATALA

SEQ ID NO: 2316 - protein, 7 aa, synthetic construct
  REGION 1..7: note = n-mer motif
GIYPAST

SEQ ID NO: 2317 - protein, 7 aa, synthetic construct
  REGION 1..7: note = n-mer motif
GFDGKQL

SEQ ID NO: 2318 - protein, 7 aa, synthetic construct
  REGION 1..7: note = n-mer motif
HSMSANT

SEQ ID NO: 2319 - protein, 7 aa, synthetic construct
  REGION 1..7: note = n-mer motif
WSIKNQT

SEQ ID NO: 2320 - protein, 7 aa, synthetic construct
  REGION 1..7: note = n-mer motif
TLHTKDL

SEQ ID NO: 2321 - protein, 7 aa, synthetic construct
  REGION 1..7: note = n-mer motif
SYGNTHD

SEQ ID NO: 2322 - protein, 7 aa, synthetic construct
  REGION 1..7: note = n-mer motif
QSGSLVP

SEQ ID NO: 2323 - protein, 7 aa, synthetic construct
  REGION 1..7: note = n-mer motif
NTLQNSH

SEQ ID NO: 2324 - protein, 7 aa, synthetic construct
  REGION 1..7: note = n-mer motif
TAESSHP

SEQ ID NO: 2325 - protein, 7 aa, synthetic construct
  REGION 1..7: note = n-mer motif
ASTVSLY

SEQ ID NO: 2326 - protein, 7 aa, synthetic construct
  REGION 1..7: note = n-mer motif
LTAVAIS

SEQ ID NO: 2327 - protein, 7 aa, synthetic construct
  REGION 1..7: note = n-mer motif
VSGQSAY

SEQ ID NO: 2328 - protein, 7 aa, synthetic construct
  REGION 1..7: note = n-mer motif
GETNFPT

SEQ ID NO: 2329 - protein, 7 aa, synthetic construct
  REGION 1..7: note = n-mer motif
NDNRSMN

SEQ ID NO: 2330 - protein, 7 aa, synthetic construct
  REGION 1..7: note = n-mer motif
RSGDPKN

SEQ ID NO: 2331 - protein, 7 aa, synthetic construct
  REGION 1..7: note = n-mer motif
WESDKFR

SEQ ID NO: 2332 - protein, 7 aa, synthetic construct
  REGION 1..7: note = n-mer motif
QVNHNTS

SEQ ID NO: 2333 - protein, 7 aa, synthetic construct
  REGION 1..7: note = n-mer motif
GWSNNEL

SEQ ID NO: 2334 - protein, 7 aa, synthetic construct
  REGION 1..7: note = n-mer motif
RAVLATN

SEQ ID NO: 2335 - protein, 7 aa, synthetic construct
  REGION 1..7: note = n-mer motif
HMGLNEL

SEQ ID NO: 2336 - protein, 7 aa, synthetic construct
  REGION 1..7: note = n-mer motif
GESSSIS

SEQ ID NO: 2337 - protein, 7 aa, synthetic construct
  REGION 1..7: note = n-mer motif
IHKSSVE

SEQ ID NO: 2338 - protein, 7 aa, synthetic construct
  REGION 1..7: note = n-mer motif
MSGSMIS

SEQ ID NO: 2339 - protein, 7 aa, synthetic construct
  REGION 1..7: note = n-mer motif
LSLAGNR

SEQ ID NO: 2340 - protein, 7 aa, synthetic construct
  REGION 1..7: note = n-mer motif
SATTNHG

SEQ ID NO: 2341 - protein, 7 aa, synthetic construct
  REGION 1..7: note = n-mer motif
STESNAS

SEQ ID NO: 2342 - protein, 7 aa, synthetic construct
  REGION 1..7: note = n-mer motif
PIAERPS

SEQ ID NO: 2343 - protein, 7 aa, synthetic construct
  REGION 1..7: note = n-mer motif
LLPNNTH

SEQ ID NO: 2344 - protein, 7 aa, synthetic construct
  REGION 1..7: note = n-mer motif
GTLKKDA

SEQ ID NO: 2345 - protein, 7 aa, synthetic construct
  REGION 1..7: note = n-mer motif
ALENRSL

SEQ ID NO: 2346 - protein, 7 aa, synthetic construct
  REGION 1..7: note = n-mer motif
TTGNSTM

SEQ ID NO: 2347 - protein, 7 aa, synthetic construct
  REGION 1..7: note = n-mer motif
VYDSAPN

SEQ ID NO: 2348 - protein, 7 aa, synthetic construct
  REGION 1..7: note = n-mer motif
LLSKGDS

SEQ ID NO: 2349 - protein, 7 aa, synthetic construct
  REGION 1..7: note = n-mer motif
SYAINQS

SEQ ID NO: 2350 - protein, 7 aa, synthetic construct
  REGION 1..7: note = n-mer motif
GGGERST

SEQ ID NO: 2351 - protein, 7 aa, synthetic construct
  REGION 1..7: note = n-mer motif
IQVSGSQ

SEQ ID NO: 2352 - protein, 7 aa, synthetic construct
  REGION 1..7: note = n-mer motif
YPVSLSP

SEQ ID NO: 2353 - protein, 7 aa, synthetic construct
  REGION 1..7: note = n-mer motif
ELGNKTA

SEQ ID NO: 2354 - protein, 7 aa, synthetic construct
  REGION 1..7: note = n-mer motif
SGVNFGV

SEQ ID NO: 2355 - protein, 7 aa, synthetic construct
  REGION 1..7: note = n-mer motif
AWSSPSG

SEQ ID NO: 2356 - protein, 7 aa, synthetic construct
  REGION 1..7: note = n-mer motif
GVNYHTT

SEQ ID NO: 2357 - protein, 7 aa, synthetic construct
  REGION 1..7: note = n-mer motif
LIGELKM

SEQ ID NO: 2358 - protein, 7 aa, synthetic construct
  REGION 1..7: note = n-mer motif
YLNSKQL

SEQ ID NO: 2359 - protein, 7 aa, synthetic construct
  REGION 1..7: note = n-mer motif
TVDRPIV

SEQ ID NO: 2360 - protein, 7 aa, synthetic construct
  REGION 1..7: note = n-mer motif
VSKTKDS

SEQ ID NO: 2361 - protein, 7 aa, synthetic construct
  REGION 1..7: note = n-mer motif
QAGNAPR

SEQ ID NO: 2362 - protein, 7 aa, synthetic construct
  REGION 1..7: note = n-mer motif
QDQTSNR

SEQ ID NO: 2363 - protein, 7 aa, synthetic construct
  REGION 1..7: note = n-mer motif
DTTYRNT

SEQ ID NO: 2364 - protein, 7 aa, synthetic construct
  REGION 1..7: note = n-mer motif
GTTEVNK

SEQ ID NO: 2365 - protein, 7 aa, synthetic construct
  REGION 1..7: note = n-mer motif
GFTNTSK

SEQ ID NO: 2366 - protein, 7 aa, synthetic construct
  REGION 1..7: note = n-mer motif
VQKNDVL

SEQ ID NO: 2367 - protein, 7 aa, synthetic construct
  REGION 1..7: note = n-mer motif
SVNNMRL

SEQ ID NO: 2368 - protein, 7 aa, synthetic construct
  REGION 1..7: note = n-mer motif
FSAALPL

SEQ ID NO: 2369 - protein, 7 aa, synthetic construct
  REGION 1..7: note = n-mer motif
DVPNNKR

SEQ ID NO: 2370 - protein, 7 aa, synthetic construct
  REGION 1..7: note = n-mer motif
GETMRHN

SEQ ID NO: 2371 - protein, 7 aa, synthetic construct
  REGION 1..7: note = n-mer motif
IRTSVIN

SEQ ID NO: 2372 - protein, 7 aa, synthetic construct
  REGION 1..7: note = n-mer motif
PRAPGHN

SEQ ID NO: 2373 - protein, 7 aa, synthetic construct
  REGION 1..7: note = n-mer motif
SVAHPLS

SEQ ID NO: 2374 - protein, 7 aa, synthetic construct
  REGION 1..7: note = n-mer motif
MTITVEP

SEQ ID NO: 2375 - protein, 7 aa, synthetic construct
  REGION 1..7: note = n-mer motif
PLNANGS

SEQ ID NO: 2376 - protein, 7 aa, synthetic construct
  REGION 1..7: note = n-mer motif
NRQRDFE

SEQ ID NO: 2377 - protein, 7 aa, synthetic construct
  REGION 1..7: note = n-mer motif
DIHNPRT

SEQ ID NO: 2378 - protein, 7 aa, synthetic construct
  REGION 1..7: note = n-mer motif
WIAGNHS

SEQ ID NO: 2379 - protein, 7 aa, synthetic construct
  REGION 1..7: note = n-mer motif
STHHADR

SEQ ID NO: 2380 - protein, 7 aa, synthetic construct
  REGION 1..7: note = n-mer motif
PESAAKS

SEQ ID NO: 2381 - protein, 7 aa, synthetic construct
  REGION 1..7: note = n-mer motif
HSDKVSS

SEQ ID NO: 2382 - protein, 7 aa, synthetic construct
  REGION 1..7: note = n-mer motif
SNSADAG

SEQ ID NO: 2383 - protein, 7 aa, synthetic construct
  REGION 1..7: note = n-mer motif
EFQRIRE

SEQ ID NO: 2384 - protein, 7 aa, synthetic construct
  REGION 1..7: note = n-mer motif
SAGMTLD

SEQ ID NO: 2385 - protein, 7 aa, synthetic construct
  REGION 1..7: note = n-mer motif
TQTSTWT

SEQ ID NO: 2386 - protein, 7 aa, synthetic construct
  REGION 1..7: note = n-mer motif
TTLTQTD

SEQ ID NO: 2387 - protein, 7 aa, synthetic construct
  REGION 1..7: note = n-mer motif
ASKGFGH

SEQ ID NO: 2388 - protein, 7 aa, synthetic construct
  REGION 1..7: note = n-mer motif
PATMISE

SEQ ID NO: 2389 - protein, 7 aa, synthetic construct
  REGION 1..7: note = n-mer motif
TDSSADS

SEQ ID NO: 2390 - protein, 7 aa, synthetic construct
  REGION 1..7: note = n-mer motif
STRKEHD

SEQ ID NO: 2391 - protein, 7 aa, synthetic construct
  REGION 1..7: note = n-mer motif
GDISYRV

SEQ ID NO: 2392 - protein, 7 aa, synthetic construct
  REGION 1..7: note = n-mer motif
MGYVDSL

SEQ ID NO: 2393 - protein, 7 aa, synthetic construct
  REGION 1..7: note = n-mer motif
QTITSQM

SEQ ID NO: 2394 - protein, 7 aa, synthetic construct
  REGION 1..7: note = n-mer motif
SIGYSPP

SEQ ID NO: 2395 - protein, 7 aa, synthetic construct
  REGION 1..7: note = n-mer motif
SSPDSYR

SEQ ID NO: 2396 - protein, 7 aa, synthetic construct
  REGION 1..7: note = n-mer motif
ISPSASN

SEQ ID NO: 2397 - protein, 7 aa, synthetic construct
  REGION 1..7: note = n-mer motif
YPADHRT

SEQ ID NO: 2398 - protein, 7 aa, synthetic construct
  REGION 1..7: note = n-mer motif
HTGQTPS

SEQ ID NO: 2399 - protein, 7 aa, synthetic construct
  REGION 1..7: note = n-mer motif
QTTILAA

SEQ ID NO: 2400 - protein, 7 aa, synthetic construct
  REGION 1..7: note = n-mer motif
DGTRQVH

SEQ ID NO: 2401 - protein, 7 aa, synthetic construct
  REGION 1..7: note = n-mer motif
RSSPATN

SEQ ID NO: 2402 - protein, 7 aa, synthetic construct
  REGION 1..7: note = n-mer motif
AMSHTYK

SEQ ID NO: 2403 - protein, 7 aa, synthetic construct
  REGION 1..7: note = n-mer motif
MAAPPEH

SEQ ID NO: 2404 - protein, 7 aa, synthetic construct
  REGION 1..7: note = n-mer motif
GPSTSEA

SEQ ID NO: 2405 - protein, 7 aa, synthetic construct
  REGION 1..7: note = n-mer motif
HNHDRSS

SEQ ID NO: 2406 - protein, 7 aa, synthetic construct
  REGION 1..7: note = n-mer motif
VVPSTQA

SEQ ID NO: 2407 - protein, 7 aa, synthetic construct
  REGION 1..7: note = n-mer motif
IPVTTRN

SEQ ID NO: 2408 - protein, 7 aa, synthetic construct
  REGION 1..7: note = n-mer motif
NQLVRGT

SEQ ID NO: 2409 - protein, 7 aa, synthetic construct
  REGION 1..7: note = n-mer motif
GFALTGT

SEQ ID NO: 2410 - protein, 7 aa, synthetic construct
  REGION 1..7: note = n-mer motif
SKGGDMV

SEQ ID NO: 2411 - protein, 7 aa, synthetic construct
  REGION 1..7: note = n-mer motif
ARPGQSM

SEQ ID NO: 2412 - protein, 7 aa, synthetic construct
  REGION 1..7: note = n-mer motif
KADYESS

SEQ ID NO: 2413 - protein, 7 aa, synthetic construct
  REGION 1..7: note = n-mer motif
GPSSHIV

SEQ ID NO: 2414 - protein, 7 aa, synthetic construct
  REGION 1..7: note = n-mer motif
EVVKTTH

SEQ ID NO: 2415 - protein, 7 aa, synthetic construct
  REGION 1..7: note = n-mer motif
TLDNNHS

SEQ ID NO: 2416 - protein, 7 aa, synthetic construct
  REGION 1..7: note = n-mer motif
TIYNMGP

SEQ ID NO: 2417 - protein, 7 aa, synthetic construct
  REGION 1..7: note = n-mer motif
STMNTIT

SEQ ID NO: 2418 - protein, 7 aa, synthetic construct
  REGION 1..7: note = n-mer motif
TLARTTE

SEQ ID NO: 2419 - protein, 7 aa, synthetic construct
  REGION 1..7: note = n-mer motif
LISSQTS

SEQ ID NO: 2420 - protein, 7 aa, synthetic construct
  REGION 1..7: note = n-mer motif
QTASGDT

SEQ ID NO: 2421 - protein, 7 aa, synthetic construct
  REGION 1..7: note = n-mer motif
AHGAFPV

SEQ ID NO: 2422 - protein, 7 aa, synthetic construct
  REGION 1..7: note = n-mer motif
GETRSTA

SEQ ID NO: 2423 - protein, 7 aa, synthetic construct
  REGION 1..7: note = n-mer motif
NNYAYSA

SEQ ID NO: 2424 - protein, 7 aa, synthetic construct
  REGION 1..7: note = n-mer motif
EAYQTEK

SEQ ID NO: 2425 - protein, 7 aa, synthetic construct
  REGION 1..7: note = n-mer motif
SLAHAVS

SEQ ID NO: 2426 - protein, 7 aa, synthetic construct
  REGION 1..7: note = n-mer motif
TYQLSGN

SEQ ID NO: 2427 - protein, 7 aa, synthetic construct
  REGION 1..7: note = n-mer motif
MSERLRI

SEQ ID NO: 2428 - protein, 7 aa, synthetic construct
  REGION 1..7: note = n-mer motif
GSGKDPG

SEQ ID NO: 2429 - protein, 7 aa, synthetic construct
  REGION 1..7: note = n-mer motif
YNSNASV

SEQ ID NO: 2430 - protein, 7 aa, synthetic construct
  REGION 1..7: note = n-mer motif
TRGDMEF

SEQ ID NO: 2431 - protein, 7 aa, synthetic construct
  REGION 1..7: note = n-mer motif
GITGSPG

SEQ ID NO: 2432 - protein, 7 aa, synthetic construct
  REGION 1..7: note = n-mer motif
QHTAHPM

SEQ ID NO: 2433 - protein, 7 aa, synthetic construct
  REGION 1..7: note = n-mer motif
DTANRST

SEQ ID NO: 2434 - protein, 7 aa, synthetic construct
  REGION 1..7: note = n-mer motif
SAHDARL

SEQ ID NO: 2435 - protein, 7 aa, synthetic construct
  REGION 1..7: note = n-mer motif
LNHTLGH

SEQ ID NO: 2436 - protein, 7 aa, synthetic construct
  REGION 1..7: note = n-mer motif
GFETSSP

SEQ ID NO: 2437 - protein, 7 aa, synthetic construct
  REGION 1..7: note = n-mer motif
GTSAESR

SEQ ID NO: 2438 - protein, 7 aa, synthetic construct
  REGION 1..7: note = n-mer motif
HANYVEV

SEQ ID NO: 2439 - protein, 7 aa, synthetic construct
  REGION 1..7: note = n-mer motif
TTKPVAE

SEQ ID NO: 2440 - protein, 7 aa, synthetic construct
  REGION 1..7: note = n-mer motif
STAVTNS

SEQ ID NO: 2441 - protein, 7 aa, synthetic construct
  REGION 1..7: note = n-mer motif
LGLAGQV

SEQ ID NO: 2442 - protein, 7 aa, synthetic construct
  REGION 1..7: note = n-mer motif
VLKGTFP

SEQ ID NO: 2443 - protein, 7 aa, synthetic construct
  REGION 1..7: note = n-mer motif
MNEPGRT

SEQ ID NO: 2444 - protein, 7 aa, synthetic construct
  REGION 1..7: note = n-mer motif
TSDPLRN

SEQ ID NO: 2445 - protein, 7 aa, synthetic construct
  REGION 1..7: note = n-mer motif
RDTNTDK

SEQ ID NO: 2446 - protein, 7 aa, synthetic construct
  REGION 1..7: note = n-mer motif
ESDLRQR

SEQ ID NO: 2447 - protein, 7 aa, synthetic construct
  REGION 1..7: note = n-mer motif
SGMAGLS

SEQ ID NO: 2448 - protein, 7 aa, synthetic construct
  REGION 1..7: note = n-mer motif
IATTSGR

SEQ ID NO: 2449 - protein, 7 aa, synthetic construct
  REGION 1..7: note = n-mer motif
TIRSEGF

SEQ ID NO: 2450 - protein, 7 aa, synthetic construct
  REGION 1..7: note = n-mer motif
GLSITIA

SEQ ID NO: 2451 - protein, 7 aa, synthetic construct
  REGION 1..7: note = n-mer motif
PPTNGRM

SEQ ID NO: 2452 - protein, 7 aa, synthetic construct
  REGION 1..7: note = n-mer motif
LQDRATN

SEQ ID NO: 2453 - protein, 7 aa, synthetic construct
  REGION 1..7: note = n-mer motif
LKSTGDH

SEQ ID NO: 2454 - protein, 7 aa, synthetic construct
  REGION 1..7: note = n-mer motif
DNNNQVY

SEQ ID NO: 2455 - protein, 7 aa, synthetic construct
  REGION 1..7: note = n-mer motif
VHMESYA

SEQ ID NO: 2456 - protein, 7 aa, synthetic construct
  REGION 1..7: note = n-mer motif
DQIGHGT

SEQ ID NO: 2457 - protein, 7 aa, synthetic construct
  REGION 1..7: note = n-mer motif
GTGPHGT

SEQ ID NO: 2458 - protein, 7 aa, synthetic construct
  REGION 1..7: note = n-mer motif
IGNNTGL

SEQ ID NO: 2459 - protein, 7 aa, synthetic construct
  REGION 1..7: note = n-mer motif
LNAEYTN

SEQ ID NO: 2460 - protein, 7 aa, synthetic construct
  REGION 1..7: note = n-mer motif
VTSSASG

SEQ ID NO: 2461 - protein, 7 aa, synthetic construct
  REGION 1..7: note = n-mer motif
THVAKPD

SEQ ID NO: 2462 - protein, 7 aa, synthetic construct
  REGION 1..7: note = n-mer motif
PMNKDIL

SEQ ID NO: 2463 - protein, 7 aa, synthetic construct
  REGION 1..7: note = n-mer motif
LSLNMNE

SEQ ID NO: 2464 - protein, 7 aa, synthetic construct
  REGION 1..7: note = n-mer motif
VGNSSTH

SEQ ID NO: 2465 - protein, 7 aa, synthetic construct
  REGION 1..7: note = n-mer motif
GHGSDLT

SEQ ID NO: 2466 - protein, 7 aa, synthetic construct
  REGION 1..7: note = n-mer motif
LTQNPTN

SEQ ID NO: 2467 - protein, 7 aa, synthetic construct
  REGION 1..7: note = n-mer motif
PSDHMRT

SEQ ID NO: 2468 - protein, 7 aa, synthetic construct
  REGION 1..7: note = n-mer motif
PDSRLAA

SEQ ID NO: 2469 - protein, 7 aa, synthetic construct
  REGION 1..7: note = n-mer motif
WGSEGTI

SEQ ID NO: 2470 - protein, 7 aa, synthetic construct
  REGION 1..7: note = n-mer motif
KPTNDSY

SEQ ID NO: 2471 - protein, 7 aa, synthetic construct
  REGION 1..7: note = n-mer motif
NRGTEVY

SEQ ID NO: 2472 - protein, 7 aa, synthetic construct
  REGION 1..7: note = n-mer motif
HVITTKD

SEQ ID NO: 2473 - protein, 7 aa, synthetic construct
  REGION 1..7: note = n-mer motif
IVSNPPA

SEQ ID NO: 2474 - protein, 7 aa, synthetic construct
  REGION 1..7: note = n-mer motif
MRNDQQL

SEQ ID NO: 2475 - protein, 7 aa, synthetic construct
  REGION 1..7: note = n-mer motif
FQRDVGH

SEQ ID NO: 2476 - protein, 7 aa, synthetic construct
  REGION 1..7: note = n-mer motif
ANDNTKQ

SEQ ID NO: 2477 - protein, 7 aa, synthetic construct
  REGION 1..7: note = n-mer motif
SVPHAGD

SEQ ID NO: 2478 - protein, 7 aa, synthetic construct
  REGION 1..7: note = n-mer motif
NATPPNH

SEQ ID NO: 2479 - protein, 7 aa, synthetic construct
  REGION 1..7: note = n-mer motif
SEHTSVL

SEQ ID NO: 2480 - protein, 7 aa, synthetic construct
  REGION 1..7: note = n-mer motif
AMSQTDI

SEQ ID NO: 2481 - protein, 7 aa, synthetic construct
  REGION 1..7: note = n-mer motif
PKAPLNN

SEQ ID NO: 2482 - protein, 7 aa, synthetic construct
  REGION 1..7: note = n-mer motif
TNNLLAQ

SEQ ID NO: 2483 - protein, 7 aa, synthetic construct
  REGION 1..7: note = n-mer motif
QRQGSGV

SEQ ID NO: 2484 - protein, 7 aa, synthetic construct
  REGION 1..7: note = n-mer motif
RSDTTNA

SEQ ID NO: 2485 - protein, 7 aa, synthetic construct
  REGION 1..7: note = n-mer motif
EADKNGV

SEQ ID NO: 2486 - protein, 7 aa, synthetic construct
  REGION 1..7: note = n-mer motif
MLGGFAQ

SEQ ID NO: 2487 - protein, 7 aa, synthetic construct
  REGION 1..7: note = n-mer motif
MTHLSTD

SEQ ID NO: 2488 - protein, 7 aa, synthetic construct
  REGION 1..7: note = n-mer motif
VLSDKAF

SEQ ID NO: 2489 - protein, 7 aa, synthetic construct
  REGION 1..7: note = n-mer motif
TPSGTIK

SEQ ID NO: 2490 - protein, 7 aa, synthetic construct
  REGION 1..7: note = n-mer motif
IILMGQS

SEQ ID NO: 2491 - protein, 7 aa, synthetic construct
  REGION 1..7: note = n-mer motif
LSGGETL

SEQ ID NO: 2492 - protein, 7 aa, synthetic construct
  REGION 1..7: note = n-mer motif
TDGALGY

SEQ ID NO: 2493 - protein, 7 aa, synthetic construct
  REGION 1..7: note = n-mer motif
GNKAALT

SEQ ID NO: 2494 - DNA, 21 bp, synthetic construct
  misc_feature 1..21: note = n-mer motif encoding polynucleotide
  source 1..21: mol_type = other DNA
agaggagacttgacaacccca

SEQ ID NO: 2495 - DNA, 21 bp, synthetic construct
  misc_feature 1..21: note = n-mer motif encoding polynucleotide
  source 1..21: mol_type = other DNA
cggggtgatcttaatcagtat

SEQ ID NO: 2496 - DNA, 21 bp, synthetic construct
  misc_feature 1..21: note = n-mer motif encoding polynucleotide
  source 1..21: mol_type = other DNA
aggggtgatctttctacgcct

SEQ ID NO: 2497 - DNA, 21 bp, synthetic construct
  misc_feature 1..21: note = n-mer motif encoding polynucleotide
  source 1..21: mol_type = other DNA
cggggtgatcagctttatcat

SEQ ID NO: 2498 - DNA, 21 bp, synthetic construct
  misc_feature 1..21: note = n-mer motif encoding polynucleotide
  source 1..21: mol_type = other DNA
cgaggagacaccatgagcaaa

SEQ ID NO: 2499 - DNA, 21 bp, synthetic construct
  misc_feature 1..21: note = n-mer motif encoding polynucleotide
  source 1..21: mol_type = other DNA
aggggggatgcgacggagctt

SEQ ID NO: 2500 - DNA, 21 bp, synthetic construct
  misc_feature 1..21: note = n-mer motif encoding polynucleotide
  source 1..21: mol_type = other DNA
agaggcgacttatccacaccc

SEQ ID NO: 2501 - DNA, 21 bp, synthetic construct
  misc_feature 1..21: note = n-mer motif encoding polynucleotide
  source 1..21: mol_type = other DNA
cgcggcgacatgataaacacc

SEQ ID NO: 2502 - DNA, 21 bp, synthetic construct
  misc_feature 1..21: note = n-mer motif encoding polynucleotide
  source 1..21: mol_type = other DNA
aggggcgacctgaaccaatac

SEQ ID NO: 2503 - DNA, 21 bp, synthetic construct
  misc_feature 1..21: note = n-mer motif encoding polynucleotide
  source 1..21: mol_type = other DNA
cggggggatactatgtctaag

SEQ ID NO: 2504 - DNA, 21 bp, synthetic construct
  misc_feature 1..21: note = n-mer motif encoding polynucleotide
  source 1..21: mol_type = other DNA
cggggtgatcttactacgcct

SEQ ID NO: 2505 - DNA, 21 bp, synthetic construct
  misc_feature 1..21: note = n-mer motif encoding polynucleotide
  source 1..21: mol_type = other DNA
aggggcgacctcaacgacagc

SEQ ID NO: 2506 - DNA, 21 bp, synthetic construct
  misc_feature 1..21: note = n-mer motif encoding polynucleotide
  source 1..21: mol_type = other DNA
gcaaaccccaacatactagac

SEQ ID NO: 2507 - DNA, 21 bp, synthetic construct
  misc_feature 1..21: note = n-mer motif encoding polynucleotide
  source 1..21: mol_type = other DNA
cgaggcgacacaatgaactac

SEQ ID NO: 2508 - DNA, 21 bp, synthetic construct
  misc_feature 1..21: note = n-mer motif encoding polynucleotide
  source 1..21: mol_type = other DNA
atgagtaatttggggtatgag

SEQ ID NO: 2509 - DNA, 21 bp, synthetic construct
  misc_feature 1..21: note = n-mer motif encoding polynucleotide
  source 1..21: mol_type = other DNA
tacacctctcaaaccagcact

SEQ ID NO: 2510 - DNA, 21 bp, synthetic construct
  misc_feature 1..21: note = n-mer motif encoding polynucleotide
  source 1..21: mol_type = other DNA
ctcggaggaaacagcaggttc

SEQ ID NO: 2511 - DNA, 21 bp, synthetic construct
  misc_feature 1..21: note = n-mer motif encoding polynucleotide
  source 1..21: mol_type = other DNA
caaagccaagcgatacaacta

SEQ ID NO: 2512 - DNA, 21 bp, synthetic construct
  misc_feature 1..21: note = n-mer motif encoding polynucleotide
  source 1..21: mol_type = other DNA
aacacgtacacaccgggaaaa

SEQ ID NO: 2513 - DNA, 21 bp, synthetic construct
  misc_feature 1..21: note = n-mer motif encoding polynucleotide
  source 1..21: mol_type = other DNA
ggggcggaagcgggccgccaa

SEQ ID NO: 2514 - DNA, 21 bp, synthetic construct
  misc_feature 1..21: note = n-mer motif encoding polynucleotide
  source 1..21: mol_type = other DNA
gaacacgctacagcaaaacaa

SEQ ID NO: 2515 - DNA, 21 bp, synthetic construct
  misc_feature 1..21: note = n-mer motif encoding polynucleotide
  source 1..21: mol_type = other DNA
gcggcacaactcgtcagtcca

SEQ ID NO: 2516 - DNA, 21 bp, synthetic construct
  misc_feature 1..21: note = n-mer motif encoding polynucleotide
  source 1..21: mol_type = other DNA
gatcagacggctagtattgtt

SEQ ID NO: 2517 - DNA, 21 bp, synthetic construct
  misc_feature 1..21: note = n-mer motif encoding polynucleotide
  source 1..21: mol_type = other DNA
gttcaaacccacataggagtc

SEQ ID NO: 2518 - DNA, 21 bp, synthetic construct
  misc_feature 1..21: note = n-mer motif encoding polynucleotide
  source 1..21: mol_type = other DNA
tcttatggtaatactcatgat

SEQ ID NO: 2519 - DNA, 21 bp, synthetic construct
  misc_feature 1..21: note = n-mer motif encoding polynucleotide
  source 1..21: mol_type = other DNA
acctccacggcttcaaaacaa

SEQ ID NO: 2520 - DNA, 21 bp, synthetic construct
  misc_feature 1..21: note = n-mer motif encoding polynucleotide
  source 1..21: mol_type = other DNA
ttggtgactcatgagcggatt

SEQ ID NO: 2521 - DNA, 21 bp, synthetic construct
  misc_feature 1..21: note = n-mer motif encoding polynucleotide
  source 1..21: mol_type = other DNA
atggataagtctaataattct

SEQ ID NO: 2522 - DNA, 21 bp, synthetic construct
  misc_feature 1..21: note = n-mer motif encoding polynucleotide
  source 1..21: mol_type = other DNA
cgtggtgatatgtctcgtgag

SEQ ID NO: 2523 - DNA, 21 bp, synthetic construct
  misc_feature 1..21: note = n-mer motif encoding polynucleotide
  source 1..21: mol_type = other DNA
cgcggtgacgtggcagaaata

SEQ ID NO: 2524 - DNA, 21 bp, synthetic construct
  misc_feature 1..21: note = n-mer motif encoding polynucleotide
  source 1..21: mol_type = other DNA
ggtggcgaaaacagaacccca

SEQ ID NO: 2525 - DNA, 21 bp, synthetic construct
  misc_feature 1..21: note = n-mer motif encoding polynucleotide
  source 1..21: mol_type = other DNA
gctgggcatcagcagcttgct

SEQ ID NO: 2526 - DNA, 21 bp, synthetic construct
  misc_feature 1..21: note = n-mer motif encoding polynucleotide
  source 1..21: mol_type = other DNA
cgtcttaatagtagtatgaat

SEQ ID NO: 2527 - DNA, 21 bp, synthetic construct
  misc_feature 1..21: note = n-mer motif encoding polynucleotide
  source 1..21: mol_type = other DNA
tattatgagaagcttagtgcg

SEQ ID NO: 2528 - DNA, 21 bp, synthetic construct
  misc_feature 1..21: note = n-mer motif encoding polynucleotide
  source 1..21: mol_type = other DNA
gaagcgtccaactacgaacga

SEQ ID NO: 2529 - DNA, 21 bp, synthetic construct
  misc_feature 1..21: note = n-mer motif encoding polynucleotide
  source 1..21: mol_type = other DNA
ttccaaactgacacgcaccga

SEQ ID NO: 2530 - DNA, 21 bp, synthetic construct
  misc_feature 1..21: note = n-mer motif encoding polynucleotide
  source 1..21: mol_type = other DNA
aacagttcccaatggcccaac

SEQ ID NO: 2531 - DNA, 21 bp, synthetic construct
  misc_feature 1..21: note = n-mer motif encoding polynucleotide
  source 1..21: mol_type = other DNA
gatggtaagactacgtctaat

SEQ ID NO: 2532 - DNA, 21 bp, synthetic construct
  misc_feature 1..21: note = n-mer motif encoding polynucleotide
  source 1..21: mol_type = other DNA
gctgtgcatgcgactagtagt

SEQ ID NO: 2533 - DNA, 21 bp, synthetic construct
  misc_feature 1..21: note = n-mer motif encoding polynucleotide
  source 1..21: mol_type = other DNA
aaaacactccccggcagggaa

SEQ ID NO: 2534 - DNA, 21 bp, synthetic construct
  misc_feature 1..21: note = n-mer motif encoding polynucleotide
  source 1..21: mol_type = other DNA
atactgaaatccgacgcacca

SEQ ID NO: 2535 - DNA, 21 bp, synthetic construct
  misc_feature 1..21: note = n-mer motif encoding polynucleotide
  source 1..21: mol_type = other DNA
agtacgaatgaggctcctaag

SEQ ID NO: 2536 - DNA, 21 bp, synthetic construct
  misc_feature 1..21: note = n-mer motif encoding polynucleotide
  source 1..21: mol_type = other DNA
tttgatagtgcgaatggtcgg

SEQ ID NO: 2537 - DNA, 21 bp, synthetic construct
  misc_feature 1..21: note = n-mer motif encoding polynucleotide
  source 1..21: mol_type = other DNA
atggacgctgcgtacggtagt

SEQ ID NO: 2538 - DNA, 21 bp, synthetic construct
  misc_feature 1..21: note = n-mer motif encoding polynucleotide
  source 1..21: mol_type = other DNA
aacaaagaccacaaccacctg

SEQ ID NO: 2539 - DNA, 21 bp, synthetic construct
  misc_feature 1..21: note = n-mer motif encoding polynucleotide
  source 1..21: mol_type = other DNA
ggtcagtatagtcagacgctt

SEQ ID NO: 2540 - DNA, 21 bp, synthetic construct
  misc_feature 1..21: note = n-mer motif encoding polynucleotide
  source 1..21: mol_type = other DNA
gaagcattcccgcgagcgggc

SEQ ID NO: 2541 - DNA, 21 bp, synthetic construct
  misc_feature 1..21: note = n-mer motif encoding polynucleotide
  source 1..21: mol_type = other DNA
gaacacactcacttaaacccg

SEQ ID NO: 2542 - DNA, 21 bp, synthetic construct
  misc_feature 1..21: note = n-mer motif encoding polynucleotide
  source 1..21: mol_type = other DNA
atgcaacgcgaagacgcgaac

SEQ ID NO: 2543 - DNA, 21 bp, synthetic construct
  misc_feature 1..21: note = n-mer motif encoding polynucleotide
  source 1..21: mol_type = other DNA
ctaaccggctctgacatgaaa

SEQ ID NO: 2544 - DNA, 21 bp, synthetic construct
  misc_feature 1..21: note = n-mer motif encoding polynucleotide
  source 1..21: mol_type = other DNA
cgagtaaacaacgacgcaata

SEQ ID NO: 2545 - DNA, 21 bp, synthetic construct
  misc_feature 1..21: note = n-mer motif encoding polynucleotide
  source 1..21: mol_type = other DNA
cgtggtgaccaaggcacacac

SEQ ID NO: 2546 - DNA, 21 bp, synthetic construct
  misc_feature 1..21: note = n-mer motif encoding polynucleotide
  source 1..21: mol_type = other DNA
attaatattagtagtgatttt

SEQ ID NO: 2547 - DNA, 21 bp, synthetic construct
  misc_feature 1..21: note = n-mer motif encoding polynucleotide
  source 1..21: mol_type = other DNA
aataatgataatggttttgtt

SEQ ID NO: 2548 - DNA, 21 bp, synthetic construct
  misc_feature 1..21: note = n-mer motif encoding polynucleotide
  source 1..21: mol_type = other DNA
ttcatcgctaacactaaccca

SEQ ID NO: 2549 - DNA, 21 bp, synthetic construct
  misc_feature 1..21: note = n-mer motif encoding polynucleotide
  source 1..21: mol_type = other DNA
ggactgcacggcaccaacgca

SEQ ID NO: 2550 - DNA, 21 bp, synthetic construct
  misc_feature 1..21: note = n-mer motif encoding polynucleotide
  source 1..21: mol_type = other DNA
aaaaccatcgacatagcacaa

SEQ ID NO: 2551 - DNA, 21 bp, synthetic construct
  misc_feature 1..21: note = n-mer motif encoding polynucleotide
  source 1..21: mol_type = other DNA
tcgagtgattctcgtattccg

SEQ ID NO: 2552 - DNA, 21 bp, synthetic construct
  misc_feature 1..21: note = n-mer motif encoding polynucleotide
  source 1..21: mol_type = other DNA
tctacatctccggttaacagc

SEQ ID NO: 2553 - DNA, 21 bp, synthetic construct
  misc_feature 1..21: note = n-mer motif encoding polynucleotide
  source 1..21: mol_type = other DNA
gccagcatgccctctgtagac

SEQ ID NO: 2554 - DNA, 21 bp, synthetic construct
  misc_feature 1..21: note = n-mer motif encoding polynucleotide
  source 1..21: mol_type = other DNA
ggtcataatatggcacaggcg

SEQ ID NO: 2555 - DNA, 21 bp, synthetic construct
  misc_feature 1..21: note = n-mer motif encoding polynucleotide
  source 1..21: mol_type = other DNA
cacaacaaaccaaacggagac

SEQ ID NO: 2556 - DNA, 21 bp, synthetic construct
  misc_feature 1..21: note = n-mer motif encoding polynucleotide
  source 1..21: mol_type = other DNA
tacaggatggaaacgaaccca

SEQ ID NO: 2557 - DNA, 21 bp, synthetic construct
  misc_feature 1..21: note = n-mer motif encoding polynucleotide
  source 1..21: mol_type = other DNA
cttgggaatgtggttcatccg

SEQ ID NO: 2558 - DNA, 21 bp, synthetic construct
  misc_feature 1..21: note = n-mer motif encoding polynucleotide
  source 1..21: mol_type = other DNA
gtaacggcacaccaattatcc

SEQ ID NO: 2559 - DNA, 21 bp, synthetic construct
  misc_feature 1..21: note = n-mer motif encoding polynucleotide
  source 1..21: mol_type = other DNA
actatggtagaagtactgcca

SEQ ID NO: 2560 - DNA, 21 bp, synthetic construct
  misc_feature 1..21: note = n-mer motif encoding polynucleotide
  source 1..21: mol_type = other DNA
atcaaagggtctgggtcgcaa

SEQ ID NO: 2561 - DNA, 21 bp, synthetic construct
  misc_feature 1..21: note = n-mer motif encoding polynucleotide
  source 1..21: mol_type = other DNA
actaatggggggtcgcttaat

SEQ ID NO: 2562 - DNA, 21 bp, synthetic construct
  misc_feature 1..21: note = n-mer motif encoding polynucleotide
  source 1..21: mol_type = other DNA
ctcggaggaaacagcaggatc

SEQ ID NO: 2563 - DNA, 21 bp, synthetic construct
  misc_feature 1..21: note = n-mer motif encoding polynucleotide
  source 1..21: mol_type = other DNA
aggggtgatgcggcgaataag

SEQ ID NO: 2564 - DNA, 21 bp, synthetic construct
  misc_feature 1..21: note = n-mer motif encoding polynucleotide
  source 1..21: mol_type = other DNA
gcgttaaacgcccaagggatc

SEQ ID NO: 2565 - DNA, 21 bp, synthetic construct
  misc_feature 1..21: note = n-mer motif encoding polynucleotide
  source 1..21: mol_type = other DNA
gctgagcatgcgactagtagt

SEQ ID NO: 2566 - DNA, 21 bp, synthetic construct
  misc_feature 1..21: note = n-mer motif encoding polynucleotide
  source 1..21: mol_type = other DNA
tacttgaccaccggtactgcc

SEQ ID NO: 2567 - DNA, 21 bp, synthetic construct
  misc_feature 1..21: note = n-mer motif encoding polynucleotide
  source 1..21: mol_type = other DNA
gcggaggctcagacgcgtgtg

SEQ ID NO: 2568 - DNA, 21 bp, synthetic construct
  misc_feature 1..21: note = n-mer motif encoding polynucleotide
  source 1..21: mol_type = other DNA
gctgagcaggggctgtcttcg

SEQ ID NO: 2569 - DNA, 21 bp, synthetic construct
  misc_feature 1..21: note = n-mer motif encoding polynucleotide
  source 1..21: mol_type = other DNA
ctgattgttactcagcatgtg

SEQ ID NO: 2570 - DNA, 21 bp, synthetic construct
  misc_feature 1..21: note = n-mer motif encoding polynucleotide
  source 1..21: mol_type = other DNA
tctagttatcagtctgggctg

SEQ ID NO: 2571 - DNA, 21 bp, synthetic construct
  misc_feature 1..21: note = n-mer motif encoding polynucleotide
  source 1..21: mol_type = other DNA
gctacggtttataatgagttg

SEQ ID NO: 2572 - DNA, 21 bp, synthetic construct
  misc_feature 1..21: note = n-mer motif encoding polynucleotide
  source 1..21: mol_type = other DNA
catgatacggttggggagagg

SEQ ID NO: 2573 - DNA, 21 bp, synthetic construct
  misc_feature 1..21: note = n-mer motif encoding polynucleotide
  source 1..21: mol_type = other DNA
cgtggggatttgaatgattct

SEQ ID NO: 2574 - DNA, 21 bp, synthetic construct
  misc_feature 1..21: note = n-mer motif encoding polynucleotide
  source 1..21: mol_type = other DNA
catgatattagtctggatcgt

SEQ ID NO: 2575 - DNA, 21 bp, synthetic construct
  misc_feature 1..21: note = n-mer motif encoding polynucleotide
  source 1..21: mol_type = other DNA
acagaacaatcttactcacga

SEQ ID NO: 2576 - DNA, 21 bp, synthetic construct
  misc_feature 1..21: note = n-mer motif encoding polynucleotide
  source 1..21: mol_type = other DNA
tggtgaggggctgagtttgcc

SEQ ID NO: 2577 - DNA, 21 bp, synthetic construct
  misc_feature 1..21: note = n-mer motif encoding polynucleotide
  source 1..21: mol_type = other DNA
gctgtgcatgcgactagtaga

SEQ ID NO: 2578 - DNA, 21 bp, synthetic construct
  misc_feature 1..21: note = n-mer motif encoding polynucleotide
  source 1..21: mol_type = other DNA
attgagagtaagactgtgcag

SEQ ID NO: 2579 - DNA, 21 bp, synthetic construct
  misc_feature 1..21: note = n-mer motif encoding polynucleotide
  source 1..21: mol_type = other DNA
acgaatgttagtacgcttttg

SEQ ID NO: 2580 - DNA, 21 bp, synthetic construct
  misc_feature 1..21: note = n-mer motif encoding polynucleotide
  source 1..21: mol_type = other DNA
ccacccaacggcagcagtaga

SEQ ID NO: 2581 - DNA, 21 bp, synthetic construct
  misc_feature 1..21: note = n-mer motif encoding polynucleotide
  source 1..21: mol_type = other DNA
ccctctacacacggctacgta

SEQ ID NO: 2582 - DNA, 21 bp, synthetic construct
  misc_feature 1..21: note = n-mer motif encoding polynucleotide
  source 1..21: mol_type = other DNA
actgcggctagtactgcgagg

SEQ ID NO: 2583 - DNA, 21 bp, synthetic construct
  misc_feature 1..21: note = n-mer motif encoding polynucleotide
  source 1..21: mol_type = other DNA
tacaacgcaggcggagaacaa

SEQ ID NO: 2584 - DNA, 21 bp, synthetic construct
  misc_feature 1..21: note = n-mer motif encoding polynucleotide
  source 1..21: mol_type = other DNA
acccacaaccaacgtgaactg

SEQ ID NO: 2585 - DNA, 21 bp, synthetic construct
  misc_feature 1..21: note = n-mer motif encoding polynucleotide
  source 1..21: mol_type = other DNA
accttcacggtcgacggtaga

SEQ ID NO: 2586 - DNA, 21 bp, synthetic construct
  misc_feature 1..21: note = n-mer motif encoding polynucleotide
  source 1..21: mol_type = other DNA
cactccagccccgggtcgtca

SEQ ID NO: 2587 - DNA, 21 bp, synthetic construct
  misc_feature 1..21: note = n-mer motif encoding polynucleotide
  source 1..21: mol_type = other DNA
agtacgagtggttataatact

SEQ ID NO: 2588 - DNA, 21 bp, synthetic construct
  misc_feature 1..21: note = n-mer motif encoding polynucleotide
  source 1..21: mol_type = other DNA
tctgagaagctgactgataag

SEQ ID NO: 2589 - DNA, 21 bp, synthetic construct
  misc_feature 1..21: note = n-mer motif encoding polynucleotide
  source 1..21: mol_type = other DNA
gggaggaacacaagtaacttg

SEQ ID NO: 2590 - DNA, 21 bp, synthetic construct
  misc_feature 1..21: note = n-mer motif encoding polynucleotide
  source 1..21: mol_type = other DNA
accggaacagcgatctcccga

SEQ ID NO: 2591 - DNA, 21 bp, synthetic construct
  misc_feature 1..21: note = n-mer motif encoding polynucleotide
  source 1..21: mol_type = other DNA
tctatgcaggatccttctttg

SEQ ID NO: 2592 - DNA, 21 bp, synthetic construct
  misc_feature 1..21: note = n-mer motif encoding polynucleotide
  source 1..21: mol_type = other DNA
actcggagtgatattggtgtg

SEQ ID NO: 2593 - DNA, 21 bp, synthetic construct
  misc_feature 1..21: note = n-mer motif encoding polynucleotide
  source 1..21: mol_type = other DNA
acgcagaatcatcagttgtct

SEQ ID NO: 2594 - DNA, 21 bp, synthetic construct
  misc_feature 1..21: note = n-mer motif encoding polynucleotide
  source 1..21: mol_type = other DNA
tttgttgataataggcagcct

SEQ ID NO: 2595 - DNA, 21 bp, synthetic construct
  misc_feature 1..21: note = n-mer motif encoding polynucleotide
  source 1..21: mol_type = other DNA
agtttgaattcttcgagtact

SEQ ID NO: 2596 - DNA, 21 bp, synthetic construct
  misc_feature 1..21: note = n-mer motif encoding polynucleotide
  source 1..21: mol_type = other DNA
aaggcggtttcggagattatt

SEQ ID NO: 2597 - DNA, 21 bp, synthetic construct
  misc_feature 1..21: note = n-mer motif encoding polynucleotide
  source 1..21: mol_type = other DNA
ggtacgagtgataattatagg

SEQ ID NO: 2598 - DNA, 21 bp, synthetic construct
  misc_feature 1..21: note = n-mer motif encoding polynucleotide
  source 1..21: mol_type = other DNA
atgtctagccacaccgtccaa

SEQ ID NO: 2599 - DNA, 21 bp, synthetic construct
  misc_feature 1..21: note = n-mer motif encoding polynucleotide
  source 1..21: mol_type = other DNA
agtatcacccacagcaacacc

SEQ ID NO: 2600 - DNA, 21 bp, synthetic construct
  misc_feature 1..21: note = n-mer motif encoding polynucleotide
  source 1..21: mol_type = other DNA
gttcagactagtactggtgct

SEQ ID NO: 2601 - DNA, 21 bp, synthetic construct
  misc_feature 1..21: note = n-mer motif encoding polynucleotide
  source 1..21: mol_type = other DNA
cgtggtgatatgactcgtgcg

SEQ ID NO: 2602 - DNA, 21 bp, synthetic construct
  misc_feature 1..21: note = n-mer motif encoding polynucleotide
  source 1..21: mol_type = other DNA
attggtctgcagaattctact

SEQ ID NO: 2603 - DNA, 21 bp, synthetic construct
  misc_feature 1..21: note = n-mer motif encoding polynucleotide
  source 1..21: mol_type = other DNA
agtgcggatcgtgataataag

SEQ ID NO: 2604 - DNA, 21 bp, synthetic construct
  misc_feature 1..21: note = n-mer motif encoding polynucleotide
  source 1..21: mol_type = other DNA
tactctcaatccataaaaaac

SEQ ID NO: 2605 - DNA, 21 bp, synthetic construct
  misc_feature 1..21: note = n-mer motif encoding polynucleotide
  source 1..21: mol_type = other DNA
cgctcgttggacagcgggatg

SEQ ID NO: 2606 - DNA, 21 bp, synthetic construct
  misc_feature 1..21: note = n-mer motif encoding polynucleotide
  source 1..21: mol_type = other DNA
gctgtgcctcagtctctgcct

SEQ ID NO: 2607 - DNA, 21 bp, synthetic construct
  misc_feature 1..21: note = n-mer motif encoding polynucleotide
  source 1..21: mol_type = other DNA
gcgaatgatagtattaagctg

SEQ ID NO: 2608 - DNA, 21 bp, synthetic construct
  misc_feature 1..21: note = n-mer motif encoding polynucleotide
  source 1..21: mol_type = other DNA
aatggtaatatttatccgtct

SEQ ID NO: 2609 - DNA, 21 bp, synthetic construct
  misc_feature 1..21: note = n-mer motif encoding polynucleotide
  source 1..21: mol_type = other DNA
gggcaaacaaacgcagtacac

SEQ ID NO: 2610 - DNA, 21 bp, synthetic construct
  misc_feature 1..21: note = n-mer motif encoding polynucleotide
  source 1..21: mol_type = other DNA
caaggagacctacgtggctcg

SEQ ID NO: 2611 - DNA, 21 bp, synthetic construct
  misc_feature 1..21: note = n-mer motif encoding polynucleotide
  source 1..21: mol_type = other DNA
gttaaggcgagtgctggggtt

SEQ ID NO: 2612 - DNA, 21 bp, synthetic construct
  misc_feature 1..21: note = n-mer motif encoding polynucleotide
  source 1..21: mol_type = other DNA
atcgcgtcaacgtggaacatg

SEQ ID NO: 2613 - DNA, 21 bp, synthetic construct
  misc_feature 1..21: note = n-mer motif encoding polynucleotide
  source 1..21: mol_type = other DNA
aactcggctgaatcctcgaga

SEQ ID NO: 2614 - DNA, 21 bp, synthetic construct
  misc_feature 1..21: note = n-mer motif encoding polynucleotide
  source 1..21: mol_type = other DNA
gtcttcacgggccaaactgaa

SEQ ID NO: 2615 - DNA, 21 bp, synthetic construct
  misc_feature 1..21: note = n-mer motif encoding polynucleotide
  source 1..21: mol_type = other DNA
tttggtacttcttatacgact

SEQ ID NO: 2616 - DNA, 21 bp, synthetic construct
  misc_feature 1..21: note = n-mer motif encoding polynucleotide
  source 1..21: mol_type = other DNA
gcggttaatgagactaggctt

SEQ ID NO: 2617 - DNA, 21 bp, synthetic construct
  misc_feature 1..21: note = n-mer motif encoding polynucleotide
  source 1..21: mol_type = other DNA
ggtcggacggatactcctaat

SEQ ID NO: 2618 - DNA, 21 bp, synthetic construct
  misc_feature 1..21: note = n-mer motif encoding polynucleotide
  source 1..21: mol_type = other DNA
aacgaccgaccgcttgccagc

SEQ ID NO: 2619 - DNA, 21 bp, synthetic construct
  misc_feature 1..21: note = n-mer motif encoding polynucleotide
  source 1..21: mol_type = other DNA
gcttatcagctgactccggct

SEQ ID NO: 2620 - DNA, 21 bp, synthetic construct
  misc_feature 1..21: note = n-mer motif encoding polynucleotide
  source 1..21: mol_type = other DNA
atgggtgagatgggtaatatt

SEQ ID NO: 2621 - DNA, 21 bp, synthetic construct
  misc_feature 1..21: note = n-mer motif encoding polynucleotide
  source 1..21: mol_type = other DNA
gcggacatgcaacacaccgta

SEQ ID NO: 2622 - DNA, 21 bp, synthetic construct
  misc_feature 1..21: note = n-mer motif encoding polynucleotide
  source 1..21: mol_type = other DNA
gcggttgttctgaatagtaat

SEQ ID NO: 2623 - DNA, 21 bp, synthetic construct
  misc_feature 1..21: note = n-mer motif encoding polynucleotide
  source 1..21: mol_type = other DNA
tttcgtgatggtcagggtatg

SEQ ID NO: 2624 - DNA, 21 bp, synthetic construct
  misc_feature 1..21: note = n-mer motif encoding polynucleotide
  source 1..21: mol_type = other DNA
aaatcgacatcaaacatcgaa

SEQ ID NO: 2625 - DNA, 21 bp, synthetic construct
  misc_feature 1..21: note = n-mer motif encoding polynucleotide
  source 1..21: mol_type = other DNA
acccaagccttctccctaggc

SEQ ID NO: 2626 - DNA, 21 bp, synthetic construct
  misc_feature 1..21: note = n-mer motif encoding polynucleotide
  source 1..21: mol_type = other DNA
tggtcgagaactggaaacacc

SEQ ID NO: 2627 - DNA, 21 bp, synthetic construct
  misc_feature 1..21: note = n-mer motif encoding polynucleotide
  source 1..21: mol_type = other DNA
agcacaaacaccgaacctagg

SEQ ID NO: 2628 - DNA, 21 bp, synthetic construct
  misc_feature 1..21: note = n-mer motif encoding polynucleotide
  source 1..21: mol_type = other DNA
gagaatagtgatttgtcttat

SEQ ID NO: 2629 - DNA, 21 bp, synthetic construct
  misc_feature 1..21: note = n-mer motif encoding polynucleotide
  source 1..21: mol_type = other DNA
atagacgaacgttcctcgata

SEQ ID NO: 2630 - DNA, 21 bp, synthetic construct
  misc_feature 1..21: note = n-mer motif encoding polynucleotide
  source 1..21: mol_type = other DNA
gatgtgcattcgagtattcct

SEQ ID NO: 2631 - DNA, 21 bp, synthetic construct
  misc_feature 1..21: note = n-mer motif encoding polynucleotide
  source 1..21: mol_type = other DNA
ataagcggttccactacacac

SEQ ID NO: 2632 - DNA, 21 bp, synthetic construct
  misc_feature 1..21: note = n-mer motif encoding polynucleotide
  source 1..21: mol_type = other DNA
tggcaaacccaagtcactaca

SEQ ID NO: 2633 - DNA, 21 bp, synthetic construct
  misc_feature 1..21: note = n-mer motif encoding polynucleotide
  source 1..21: mol_type = other DNA
aacatgggtccaatgggccgg

SEQ ID NO: 2634 - DNA, 21 bp, synthetic construct
  misc_feature 1..21: note = n-mer motif encoding polynucleotide
  source 1..21: mol_type = other DNA
gttacccaatcgtccacgcta

SEQ ID NO: 2635 - DNA, 21 bp, synthetic construct
  misc_feature 1..21: note = n-mer motif encoding polynucleotide
  source 1..21: mol_type = other DNA
attgatcgtagtgctagtttg

SEQ ID NO: 2636 - DNA, 21 bp, synthetic construct
  misc_feature 1..21: note = n-mer motif encoding polynucleotide
  source 1..21: mol_type = other DNA
tctcatagtattacgggtctt

SEQ ID NO: 2637 - DNA, 21 bp, synthetic construct
  misc_feature 1..21: note = n-mer motif encoding polynucleotide
  source 1..21: mol_type = other DNA
aaagcgggacaactagtggaa

SEQ ID NO: 2638 - DNA, 21 bp, synthetic construct
  misc_feature 1..21: note = n-mer motif encoding polynucleotide
  source 1..21: mol_type = other DNA
agcggtgtatcagaaggaaac

SEQ ID NO: 2639 - DNA, 21 bp, synthetic construct
  misc_feature 1..21: note = n-mer motif encoding polynucleotide
  source 1..21: mol_type = other DNA
acgcttacattatctaccctc

SEQ ID NO: 2640 - DNA, 21 bp, synthetic construct
  misc_feature 1..21: note = n-mer motif encoding polynucleotide
  source 1..21: mol_type = other DNA
gcccacaacaaacacgaaagt

SEQ ID NO: 2641 - DNA, 21 bp, synthetic construct
  misc_feature 1..21: note = n-mer motif encoding polynucleotide
  source 1..21: mol_type = other DNA
cacaacaacaacctgcaaaac

SEQ ID NO: 2642 - DNA, 21 bp, synthetic construct
  misc_feature 1..21: note = n-mer motif encoding polynucleotide
  source 1..21: mol_type = other DNA
tataatgagtcttcgaatgcg

SEQ ID NO: 2643 - DNA, 21 bp, synthetic construct
  misc_feature 1..21: note = n-mer motif encoding polynucleotide
  source 1..21: mol_type = other DNA
cgtgagcaggctgcggagagg

SEQ ID NO: 2644 - DNA, 21 bp, synthetic construct
  misc_feature 1..21: note = n-mer motif encoding polynucleotide
  source 1..21: mol_type = other DNA
actcagtatggtactctgccg

SEQ ID NO: 2645 - DNA, 21 bp, synthetic construct
  misc_feature 1..21: note = n-mer motif encoding polynucleotide
  source 1..21: mol_type = other DNA
catcctgggaatagttctgtg

SEQ ID NO: 2646 - DNA, 21 bp, synthetic construct
  misc_feature 1..21: note = n-mer motif encoding polynucleotide
  source 1..21: mol_type = other DNA
agttctagggaggtgagtccg

SEQ ID NO: 2647 - DNA, 21 bp, synthetic construct
  misc_feature 1..21: note = n-mer motif encoding polynucleotide
  source 1..21: mol_type = other DNA
gcaaactccacaagccaatgg

SEQ ID NO: 2648 - DNA, 21 bp, synthetic construct
  misc_feature 1..21: note = n-mer motif encoding polynucleotide
  source 1..21: mol_type = other DNA
cgcgacatgatcaactcatca

SEQ ID NO: 2649 - DNA, 21 bp, synthetic construct
  misc_feature 1..21: note = n-mer motif encoding polynucleotide
  source 1..21: mol_type = other DNA
gcattgcccagcggcgcacga

SEQ ID NO: 2650 - DNA, 21 bp, synthetic construct
  misc_feature 1..21: note = n-mer motif encoding polynucleotide
  source 1..21: mol_type = other DNA
cctggcaccagtggatcccga

SEQ ID NO: 2651 - DNA, 21 bp, synthetic construct
  misc_feature 1..21: note = n-mer motif encoding polynucleotide
  source 1..21: mol_type = other DNA
tggaacggaaacgccacacaa

SEQ ID NO: 2652 - DNA, 21 bp, synthetic construct
  misc_feature 1..21: note = n-mer motif encoding polynucleotide
  source 1..21: mol_type = other DNA
ggtaaagcaaccttagtcctc

SEQ ID NO: 2653 - DNA, 21 bp, synthetic construct
  misc_feature 1..21: note = n-mer motif encoding polynucleotide
  source 1..21: mol_type = other DNA
tacaccaacgggggccaccta

SEQ ID NO: 2654 - DNA, 21 bp, synthetic construct
  misc_feature 1..21: note = n-mer motif encoding polynucleotide
  source 1..21: mol_type = other DNA
tcacaatacaacggaacgcaa

SEQ ID NO: 2655 - DNA, 21 bp, synthetic construct
  misc_feature 1..21: note = n-mer motif encoding polynucleotide
  source 1..21: mol_type = other DNA
tattctagtgagagtgcttat

SEQ ID NO: 2656 - DNA, 21 bp, synthetic construct
  misc_feature 1..21: note = n-mer motif encoding polynucleotide
  source 1..21: mol_type = other DNA
gttaaggcgggggtggctgat

SEQ ID NO: 2657 - DNA, 21 bp, synthetic construct
  misc_feature 1..21: note = n-mer motif encoding polynucleotide
  source 1..21: mol_type = other DNA
acgatggggacggtgcagatt

SEQ ID NO: 2658 - DNA, 21 bp, synthetic construct
  misc_feature 1..21: note = n-mer motif encoding polynucleotide
  source 1..21: mol_type = other DNA
ggtgtggctggtgcggtggtg

SEQ ID NO: 2659 - DNA, 21 bp, synthetic construct
  misc_feature 1..21: note = n-mer motif encoding polynucleotide
  source 1..21: mol_type = other DNA
tatgataagactttgagtgtt

SEQ ID NO: 2660 - DNA, 21 bp, synthetic construct
  misc_feature 1..21: note = n-mer motif encoding polynucleotide
  source 1..21: mol_type = other DNA
catgggagtgcgtattcgcag

SEQ ID NO: 2661 - DNA, 21 bp, synthetic construct
  misc_feature 1..21: note = n-mer motif encoding polynucleotide
  source 1..21: mol_type = other DNA
acggctaatattatgagtaag

SEQ ID NO: 2662 - DNA, 21 bp, synthetic construct
  misc_feature 1..21: note = n-mer motif encoding polynucleotide
  source 1..21: mol_type = other DNA
ttttcgcgggagacgctggcg

SEQ ID NO: 2663 - DNA, 21 bp, synthetic construct
  misc_feature 1..21: note = n-mer motif encoding polynucleotide
  source 1..21: mol_type = other DNA
ttgagtggtgctggtagtcag

SEQ ID NO: 2664 - DNA, 21 bp, synthetic construct
  misc_feature 1..21: note = n-mer motif encoding polynucleotide
  source 1..21: mol_type = other DNA
agtaatgcgaatcagatgagt

SEQ ID NO: 2665 - DNA, 21 bp, synthetic construct
  misc_feature 1..21: note = n-mer motif encoding polynucleotide
  source 1..21: mol_type = other DNA
tcggtcctttcgccttcgaac

SEQ ID NO: 2666 - DNA, 21 bp, synthetic construct
  misc_feature 1..21: note = n-mer motif encoding polynucleotide
  source 1..21: mol_type = other DNA
gataatgtgcatgggcaggtg

SEQ ID NO: 2667 - DNA, 21 bp, synthetic construct
  misc_feature 1..21: note = n-mer motif encoding polynucleotide
  source 1..21: mol_type = other DNA
gacggacgagaatacgcctcg

SEQ ID NO: 2668 - DNA, 21 bp, synthetic construct
  misc_feature 1..21: note = n-mer motif encoding polynucleotide
  source 1..21: mol_type = other DNA
atttcgaatcagattaagatg

SEQ ID NO: 2669 - DNA, 21 bp, synthetic construct
  misc_feature 1..21: note = n-mer motif encoding polynucleotide
  source 1..21: mol_type = other DNA
ggtcgagacaaccaacacgta

SEQ ID NO: 2670 - DNA, 21 bp, synthetic construct
  misc_feature 1..21: note = n-mer motif encoding polynucleotide
  source 1..21: mol_type = other DNA
cgtaatcatgagactggggct

SEQ ID NO: 2671 - DNA, 21 bp, synthetic construct
  misc_feature 1..21: note = n-mer motif encoding polynucleotide
  source 1..21: mol_type = other DNA
agtgggagtggtgcgaatatt

SEQ ID NO: 2672 - DNA, 21 bp, synthetic construct
  misc_feature 1..21: note = n-mer motif encoding polynucleotide
  source 1..21: mol_type = other DNA
tctatgtctgatgggcttcgg

SEQ ID NO: 2673 - DNA, 21 bp, synthetic construct
  misc_feature 1..21: note = n-mer motif encoding polynucleotide
  source 1..21: mol_type = other DNA
aaggagagtagtgctatggag

SEQ ID NO: 2674 - DNA, 21 bp, synthetic construct
  misc_feature 1..21: note = n-mer motif encoding polynucleotide
  source 1..21: mol_type = other DNA
gctaatgctagtactagtctg

SEQ ID NO: 2675 - DNA, 21 bp, synthetic construct
  misc_feature 1..21: note = n-mer motif encoding polynucleotide
  source 1..21: mol_type = other DNA
agtgcttctggttatttggtt

SEQ ID NO: 2676 - DNA, 21 bp, synthetic construct
  misc_feature 1..21: note = n-mer motif encoding polynucleotide
  source 1..21: mol_type = other DNA
gatactactcagaagcctcat

SEQ ID NO: 2677 - DNA, 21 bp, synthetic construct
  misc_feature 1..21: note = n-mer motif encoding polynucleotide
  source 1..21: mol_type = other DNA
ctaatacgaggttccatggaa

SEQ ID NO: 2678 - DNA, 21 bp, synthetic construct
  misc_feature 1..21: note = n-mer motif encoding polynucleotide
  source 1..21: mol_type = other DNA
gaccgcacctactcaaacaca

SEQ ID NO: 2679 - DNA, 21 bp, synthetic construct
  misc_feature 1..21: note = n-mer motif encoding polynucleotide
  source 1..21: mol_type = other DNA
gctcttgggcatcaggggaat

SEQ ID NO: 2680 - DNA, 21 bp, synthetic construct
  misc_feature 1..21: note = n-mer motif encoding polynucleotide
  source 1..21: mol_type = other DNA
gctaatcatacgtcgcaggag

SEQ ID NO: 2681 - DNA, 21 bp, synthetic construct
  misc_feature 1..21: note = n-mer motif encoding polynucleotide
  source 1..21: mol_type = other DNA
gagaggggtttgaatactaat

SEQ ID NO: 2682 - DNA, 21 bp, synthetic construct
  misc_feature 1..21: note = n-mer motif encoding polynucleotide
  source 1..21: mol_type = other DNA
actgttggtggtaatcatcat

SEQ ID NO: 2683 - DNA, 21 bp, synthetic construct
  misc_feature 1..21: note = n-mer motif encoding polynucleotide
  source 1..21: mol_type = other DNA
ccgagtgataggactacttat

SEQ ID NO: 2684 - DNA, 21 bp, synthetic construct
  misc_feature 1..21: note = n-mer motif encoding polynucleotide
  source 1..21: mol_type = other DNA
tccaggcaagaaaacttctcc

SEQ ID NO: 2685 - DNA, 21 bp, synthetic construct
  misc_feature 1..21: note = n-mer motif encoding polynucleotide
  source 1..21: mol_type = other DNA
aataagacgacgatggagttt

SEQ ID NO: 2686 - DNA, 21 bp, synthetic construct
  misc_feature 1..21: note = n-mer motif encoding polynucleotide
  source 1..21: mol_type = other DNA
aaacacacagaaaacgggacc

SEQ ID NO: 2687 - DNA, 21 bp, synthetic construct
  misc_feature 1..21: note = n-mer motif encoding polynucleotide
  source 1..21: mol_type = other DNA
gaaaccggagctatgacctct

SEQ ID NO: 2688 - DNA, 21 bp, synthetic construct
  misc_feature 1..21: note = n-mer motif encoding polynucleotide
  source 1..21: mol_type = other DNA
ggtcatagggattcgggtggt

SEQ ID NO: 2689 - DNA, 21 bp, synthetic construct
  misc_feature 1..21: note = n-mer motif encoding polynucleotide
  source 1..21: mol_type = other DNA
agaaacgccgaaggcggattg

SEQ ID NO: 2690 - DNA, 21 bp, synthetic construct
  misc_feature 1..21: note = n-mer motif encoding polynucleotide
  source 1..21: mol_type = other DNA
gggcagcgtacgacgaatgat

SEQ ID NO: 2691 - DNA, 21 bp, synthetic construct
  misc_feature 1..21: note = n-mer motif encoding polynucleotide
  source 1..21: mol_type = other DNA
tataatgatgctcttaggccg

SEQ ID NO: 2692 - DNA, 21 bp, synthetic construct
  misc_feature 1..21: note = n-mer motif encoding polynucleotide
  source 1..21: mol_type = other DNA
gggtatgcgactacggttcag

SEQ ID NO: 2693 - DNA, 21 bp, synthetic construct
  misc_feature 1..21: note = n-mer motif encoding polynucleotide
  source 1..21: mol_type = other DNA
atagggggaggcataggaaac

SEQ ID NO: 2694 - DNA, 21 bp, synthetic construct
  misc_feature 1..21: note = n-mer motif encoding polynucleotide
  source 1..21: mol_type = other DNA
gtggcggtgtctaatacgcct

SEQ ID NO: 2695 - DNA, 21 bp, synthetic construct
  misc_feature 1..21: note = n-mer motif encoding polynucleotide
  source 1..21: mol_type = other DNA
cttgcgaatggtatgacggct

SEQ ID NO: 2696 - DNA, 21 bp, synthetic construct
  misc_feature 1..21: note = n-mer motif encoding polynucleotide
  source 1..21: mol_type = other DNA
atttctgggtcgtcgtctctt

SEQ ID NO: 2697 - DNA, 21 bp, synthetic construct
  misc_feature 1..21: note = n-mer motif encoding polynucleotide
  source 1..21: mol_type = other DNA
tctaatgttcatgttgttaat

SEQ ID NO: 2698 - DNA, 21 bp, synthetic construct
  misc_feature 1..21: note = n-mer motif encoding polynucleotide
  source 1..21: mol_type = other DNA
gtggagacttcgcgtctgtat

SEQ ID NO: 2699 - DNA, 21 bp, synthetic construct
  misc_feature 1..21: note = n-mer motif encoding polynucleotide
  source 1..21: mol_type = other DNA
tcgaacgcagacatcctcgcc

SEQ ID NO: 2700 - DNA, 21 bp, synthetic construct
  misc_feature 1..21: note = n-mer motif encoding polynucleotide
  source 1..21: mol_type = other DNA
aacaacgtaaacccgtactcg

SEQ ID NO: 2701 - DNA, 21 bp, synthetic construct
  misc_feature 1..21: note = n-mer motif encoding polynucleotide
  source 1..21: mol_type = other DNA
ataagtgtaggtgtgtccgta

SEQ ID NO: 2702 - DNA, 21 bp, synthetic construct
  misc_feature 1..21: note = n-mer motif encoding polynucleotide
  source 1..21: mol_type = other DNA
tccgcaaacaacatagccccc

SEQ ID NO: 2703 - DNA, 21 bp, synthetic construct
  misc_feature 1..21: note = n-mer motif encoding polynucleotide
  source 1..21: mol_type = other DNA
ggtgttcagatgactgcgggg

SEQ ID NO: 2704 - DNA, 21 bp, synthetic construct
  misc_feature 1..21: note = n-mer motif encoding polynucleotide
  source 1..21: mol_type = other DNA
cgttacatcgccaaccaaaca

SEQ ID NO: 2705 - DNA, 21 bp, synthetic construct
  misc_feature 1..21: note = n-mer motif encoding polynucleotide
  source 1..21: mol_type = other DNA
accaccgaaagtctacacctt

SEQ ID NO: 2706 - DNA, 21 bp, synthetic construct
  misc_feature 1..21: note = n-mer motif encoding polynucleotide
  source 1..21: mol_type = other DNA
ggctaccaagacaaaacacga

SEQ ID NO: 2707 - DNA, 21 bp, synthetic construct
  misc_feature 1..21: note = n-mer motif encoding polynucleotide
  source 1..21: mol_type = other DNA
gcttcgcggcctgcggctcag

SEQ ID NO: 2708 - DNA, 21 bp, synthetic construct
  misc_feature 1..21: note = n-mer motif encoding polynucleotide
  source 1..21: mol_type = other DNA
tctattcaggagctgttgagg

SEQ ID NO: 2709 - DNA, 21 bp, synthetic construct
  misc_feature 1..21: note = n-mer motif encoding polynucleotide
  source 1..21: mol_type = other DNA
actgtgcgttcgcctcagcag

SEQ ID NO: 2710 - DNA, 21 bp, synthetic construct
  misc_feature 1..21: note = n-mer motif encoding polynucleotide
  source 1..21: mol_type = other DNA
gcggttcttggtggtagtaat

SEQ ID NO: 2711 - DNA, 21 bp, synthetic construct
  misc_feature 1..21: note = n-mer motif encoding polynucleotide
  source 1..21: mol_type = other DNA
atgagtacggttcttcgggag

SEQ ID NO: 2712 - DNA, 21 bp, synthetic construct
  misc_feature 1..21: note = n-mer motif encoding polynucleotide
  source 1..21: mol_type = other DNA
acttatggtattactcatgat

SEQ ID NO: 2713 - DNA, 21 bp, synthetic construct
  misc_feature 1..21: note = n-mer motif encoding polynucleotide
  source 1..21: mol_type = other DNA
gatgcgaatgcgggtacgagg

SEQ ID NO: 2714 - DNA, 21 bp, synthetic construct
  misc_feature 1..21: note = n-mer motif encoding polynucleotide
  source 1..21: mol_type = other DNA
ttcaacgggtacgtcatggca

SEQ ID NO: 2715 - DNA, 21 bp, synthetic construct
  misc_feature 1..21: note = n-mer motif encoding polynucleotide
  source 1..21: mol_type = other DNA
attaataattttaatactctg

SEQ ID NO: 2716 - DNA, 21 bp, synthetic construct
  misc_feature 1..21: note = n-mer motif encoding polynucleotide
  source 1..21: mol_type = other DNA
gtagccaacgaacgcctaccg

SEQ ID NO: 2717 - DNA, 21 bp, synthetic construct
  misc_feature 1..21: note = n-mer motif encoding polynucleotide
  source 1..21: mol_type = other DNA
actaattctaatcagggttcg

SEQ ID NO: 2718 - DNA, 21 bp, synthetic construct
  misc_feature 1..21: note = n-mer motif encoding polynucleotide
  source 1..21: mol_type = other DNA
gcgacgctgaataatagttat

SEQ ID NO: 2719 - DNA, 21 bp, synthetic construct
  misc_feature 1..21: note = n-mer motif encoding polynucleotide
  source 1..21: mol_type = other DNA
aaaaacgctcaaatagaccta

SEQ ID NO: 2720 - DNA, 21 bp, synthetic construct
  misc_feature 1..21: note = n-mer motif encoding polynucleotide
  source 1..21: mol_type = other DNA
cctgctacgctacacctgaca

SEQ ID NO: 2721 - DNA, 21 bp, synthetic construct
  misc_feature 1..21: note = n-mer motif encoding polynucleotide
  source 1..21: mol_type = other DNA
ttaggatcgagcacagtatcg

SEQ ID NO: 2722 - DNA, 21 bp, synthetic construct
  misc_feature 1..21: note = n-mer motif encoding polynucleotide
  source 1..21: mol_type = other DNA
aattggaattctgagggtacg

SEQ ID NO: 2723 - DNA, 21 bp, synthetic construct
  misc_feature 1..21: note = n-mer motif encoding polynucleotide
  source 1..21: mol_type = other DNA
ccaacaaacaacttaagtatg

SEQ ID NO: 2724 - DNA, 21 bp, synthetic construct
  misc_feature 1..21: note = n-mer motif encoding polynucleotide
  source 1..21: mol_type = other DNA
gcgcttaagccgaattctacg

SEQ ID NO: 2725 - DNA, 21 bp, synthetic construct
  misc_feature 1..21: note = n-mer motif encoding polynucleotide
  source 1..21: mol_type = other DNA
atggtgaattcggagaatact

SEQ ID NO: 2726 - DNA, 21 bp, synthetic construct
  misc_feature 1..21: note = n-mer motif encoding polynucleotide
  source 1..21: mol_type = other DNA
agtatggatgctcggttgacg

SEQ ID NO: 2727 - DNA, 21 bp, synthetic construct
  misc_feature 1..21: note = n-mer motif encoding polynucleotide
  source 1..21: mol_type = other DNA
aataatgttgttagggatgat

SEQ ID NO: 2728 - DNA, 21 bp, synthetic construct
  misc_feature 1..21: note = n-mer motif encoding polynucleotide
  source 1..21: mol_type = other DNA
acaagggaccaaaggtctaca

SEQ ID NO: 2729 - DNA, 21 bp, synthetic construct
  misc_feature 1..21: note = n-mer motif encoding polynucleotide
  source 1..21: mol_type = other DNA
gctgacatccggaacgacaaa

SEQ ID NO: 2730 - DNA, 21 bp, synthetic construct
  misc_feature 1..21: note = n-mer motif encoding polynucleotide
  source 1..21: mol_type = other DNA
atgcgggataagattaatccg

SEQ ID NO: 2731 - DNA, 21 bp, synthetic construct
  misc_feature 1..21: note = n-mer motif encoding polynucleotide
  source 1..21: mol_type = other DNA
ccgactcctaatgagcatatg

SEQ ID NO: 2732 - DNA, 21 bp, synthetic construct
  misc_feature 1..21: note = n-mer motif encoding polynucleotide
  source 1..21: mol_type = other DNA
ggatactcacacaactccgac

SEQ ID NO: 2733 - DNA, 21 bp, synthetic construct
  misc_feature 1..21: note = n-mer motif encoding polynucleotide
  source 1..21: mol_type = other DNA
cttcgggatgggattgcttct

SEQ ID NO: 2734 - DNA, 21 bp, synthetic construct
  misc_feature 1..21: note = n-mer motif encoding polynucleotide
  source 1..21: mol_type = other DNA
atgaaccaaatgggcggcctg

SEQ ID NO: 2735 - DNA, 21 bp, synthetic construct
  misc_feature 1..21: note = n-mer motif encoding polynucleotide
  source 1..21: mol_type = other DNA
tcttcgcctactaagggtact

SEQ ID NO: 2736 - DNA, 21 bp, synthetic construct
  misc_feature 1..21: note = n-mer motif encoding polynucleotide
  source 1..21: mol_type = other DNA
tatttggataatccgttgacg

SEQ ID NO: 2737 - DNA, 21 bp, synthetic construct
  misc_feature 1..21: note = n-mer motif encoding polynucleotide
  source 1..21: mol_type = other DNA
gtcatgcaacgatctgcacaa

SEQ ID NO: 2738 - DNA, 21 bp, synthetic construct
  misc_feature 1..21: note = n-mer motif encoding polynucleotide
  source 1..21: mol_type = other DNA
tctctgcaactcacagcgggt

SEQ ID NO: 2739 - DNA, 21 bp, synthetic construct
  misc_feature 1..21: note = n-mer motif encoding polynucleotide
  source 1..21: mol_type = other DNA
gtggggtctgggggttataat

SEQ ID NO: 2740 - DNA, 21 bp, synthetic construct
  misc_feature 1..21: note = n-mer motif encoding polynucleotide
  source 1..21: mol_type = other DNA
gatcgtccgaataatgtgtcg

SEQ ID NO: 2741 - DNA, 21 bp, synthetic construct
  misc_feature 1..21: note = n-mer motif encoding polynucleotide
  source 1..21: mol_type = other DNA
ttgactgagaaggcttctatt

SEQ ID NO: 2742 - DNA, 21 bp, synthetic construct
  misc_feature 1..21: note = n-mer motif encoding polynucleotide
  source 1..21: mol_type = other DNA
accacaaaaacgacatctatg

SEQ ID NO: 2743 - DNA, 21 bp, synthetic construct
  misc_feature 1..21: note = n-mer motif encoding polynucleotide
  source 1..21: mol_type = other DNA
cgtttggacctgcaagtccac

SEQ ID NO: 2744 - DNA, 21 bp, synthetic construct
  misc_feature 1..21: note = n-mer motif encoding polynucleotide
  source 1..21: mol_type = other DNA
actcatgtgattggggctgtg

SEQ ID NO: 2745 - DNA, 21 bp, synthetic construct
  misc_feature 1..21: note = n-mer motif encoding polynucleotide
  source 1..21: mol_type = other DNA
accctgacacacctaaaccca

SEQ ID NO: 2746 - DNA, 21 bp, synthetic construct
  misc_feature 1..21: note = n-mer motif encoding polynucleotide
  source 1..21: mol_type = other DNA
acctcaatatcgtcgcaaagc

SEQ ID NO: 2747 - DNA, 21 bp, synthetic construct
  misc_feature 1..21: note = n-mer motif encoding polynucleotide
  source 1..21: mol_type = other DNA
taccacacccaccaagtcgca

SEQ ID NO: 2748 - DNA, 21 bp, synthetic construct
  misc_feature 1..21: note = n-mer motif encoding polynucleotide
  source 1..21: mol_type = other DNA
atgcaagggcttaacaacatg

SEQ ID NO: 2749 - DNA, 21 bp, synthetic construct
  misc_feature 1..21: note = n-mer motif encoding polynucleotide
  source 1..21: mol_type = other DNA
ggtagtgcgagtaatagtggt

SEQ ID NO: 2750 - DNA, 21 bp, synthetic construct
  misc_feature 1..21: note = n-mer motif encoding polynucleotide
  source 1..21: mol_type = other DNA
gcgaatactacggggcaggtg

SEQ ID NO: 2751 - DNA, 21 bp, synthetic construct
  misc_feature 1..21: note = n-mer motif encoding polynucleotide
  source 1..21: mol_type = other DNA
agcgttgtcaacaccaacatc

SEQ ID NO: 2752 - DNA, 21 bp, synthetic construct
  misc_feature 1..21: note = n-mer motif encoding polynucleotide
  source 1..21: mol_type = other DNA
tctaataatctgaatcaggag

SEQ ID NO: 2753 - DNA, 21 bp, synthetic construct
  misc_feature 1..21: note = n-mer motif encoding polynucleotide
  source 1..21: mol_type = other DNA
atgaatgggagtgggatgcag

SEQ ID NO: 2754 - DNA, 21 bp, synthetic construct
  misc_feature 1..21: note = n-mer motif encoding polynucleotide
  source 1..21: mol_type = other DNA
ataagtcacgaccttaaatac

SEQ ID NO: 2755 - DNA, 21 bp, synthetic construct
  misc_feature 1..21: note = n-mer motif encoding polynucleotide
  source 1..21: mol_type = other DNA
acggttaatgcggatgggtcg

SEQ ID NO: 2756 - DNA, 21 bp, synthetic construct
  misc_feature 1..21: note = n-mer motif encoding polynucleotide
  source 1..21: mol_type = other DNA
aatcatattaggaatcctatg

SEQ ID NO: 2757 - DNA, 21 bp, synthetic construct
  misc_feature 1..21: note = n-mer motif encoding polynucleotide
  source 1..21: mol_type = other DNA
agtacgcgggttactctggat

SEQ ID NO: 2758 - DNA, 21 bp, synthetic construct
  misc_feature 1..21: note = n-mer motif encoding polynucleotide
  source 1..21: mol_type = other DNA
gctatgggagcactcgtgcac

SEQ ID NO: 2759 - DNA, 21 bp, synthetic construct
  misc_feature 1..21: note = n-mer motif encoding polynucleotide
  source 1..21: mol_type = other DNA
gcgcaagccatgtcaaacagc

SEQ ID NO: 2760 - DNA, 21 bp, synthetic construct
  misc_feature 1..21: note = n-mer motif encoding polynucleotide
  source 1..21: mol_type = other DNA
aatgctaatggtatgaatact

SEQ ID NO: 2761 - DNA, 21 bp, synthetic construct
  misc_feature 1..21: note = n-mer motif encoding polynucleotide
  source 1..21: mol_type = other DNA
ttgacgcttcctagtgctaat

SEQ ID NO: 2762 - DNA, 21 bp, synthetic construct
  misc_feature 1..21: note = n-mer motif encoding polynucleotide
  source 1..21: mol_type = other DNA
taccaaacgggagacaaagac

SEQ ID NO: 2763 - DNA, 21 bp, synthetic construct
  misc_feature 1..21: note = n-mer motif encoding polynucleotide
  source 1..21: mol_type = other DNA
agacgggaagaaaacgtcaac

SEQ ID NO: 2764 - DNA, 21 bp, synthetic construct
  misc_feature 1..21: note = n-mer motif encoding polynucleotide
  source 1..21: mol_type = other DNA
ggaactaccacggcagtcgcg

SEQ ID NO: 2765 - DNA, 21 bp, synthetic construct
  misc_feature 1..21: note = n-mer motif encoding polynucleotide
  source 1..21: mol_type = other DNA
acggctggtggggagcgtgcg

SEQ ID NO: 2766 - DNA, 21 bp, synthetic construct
  misc_feature 1..21: note = n-mer motif encoding polynucleotide
  source 1..21: mol_type = other DNA
gccggtaacgaacctagaccc

SEQ ID NO: 2767 - DNA, 21 bp, synthetic construct
  misc_feature 1..21: note = n-mer motif encoding polynucleotide
  source 1..21: mol_type = other DNA
gcaaacaacacagccaacagt

SEQ ID NO: 2768 - DNA, 21 bp, synthetic construct
  misc_feature 1..21: note = n-mer motif encoding polynucleotide
  source 1..21: mol_type = other DNA
catgtgaatagtagggatctt

SEQ ID NO: 2769 - DNA, 21 bp, synthetic construct
  misc_feature 1..21: note = n-mer motif encoding polynucleotide
  source 1..21: mol_type = other DNA
acataccaactttccggcaac

SEQ ID NO: 2770 - DNA, 21 bp, synthetic construct
  misc_feature 1..21: note = n-mer motif encoding polynucleotide
  source 1..21: mol_type = other DNA
cggggtgattcgatggctcgg

SEQ ID NO: 2771 - DNA, 21 bp, synthetic construct
  misc_feature 1..21: note = n-mer motif encoding polynucleotide
  source 1..21: mol_type = other DNA
ttgaataattctgcgactgtt

SEQ ID NO: 2772 - DNA, 21 bp, synthetic construct
  misc_feature 1..21: note = n-mer motif encoding polynucleotide
  source 1..21: mol_type = other DNA
ctacacgctaacaacgaacgg

SEQ ID NO: 2773 - DNA, 21 bp, synthetic construct
  misc_feature 1..21: note = n-mer motif encoding polynucleotide
  source 1..21: mol_type = other DNA
atgggttctacgactggtgtg

SEQ ID NO: 2774 - DNA, 21 bp, synthetic construct
  misc_feature 1..21: note = n-mer motif encoding polynucleotide
  source 1..21: mol_type = other DNA
gtagttgcagggcacgcaatg

SEQ ID NO: 2775 - DNA, 21 bp, synthetic construct
  misc_feature 1..21: note = n-mer motif encoding polynucleotide
  source 1..21: mol_type = other DNA
ggcaacgaaaaaccatcaggg

SEQ ID NO: 2776 - DNA, 21 bp, synthetic construct
  misc_feature 1..21: note = n-mer motif encoding polynucleotide
  source 1..21: mol_type = other DNA
cgtggtacggaggggacgccg

SEQ ID NO: 2777 - DNA, 21 bp, synthetic construct
  misc_feature 1..21: note = n-mer motif encoding polynucleotide
  source 1..21: mol_type = other DNA
tggtcccccggacccgaagcc

SEQ ID NO: 2778 - DNA, 21 bp, synthetic construct
  misc_feature 1..21: note = n-mer motif encoding polynucleotide
  source 1..21: mol_type = other DNA
attaatgtgaatcagatggcg

SEQ ID NO: 2779 - DNA, 21 bp, synthetic construct
  misc_feature 1..21: note = n-mer motif encoding polynucleotide
  source 1..21: mol_type = other DNA
cggtcggacgttatgcaaagt

SEQ ID NO: 2780 - DNA, 21 bp, synthetic construct
  misc_feature 1..21: note = n-mer motif encoding polynucleotide
  source 1..21: mol_type = other DNA
agggacgtaagtacaaaagaa

SEQ ID NO: 2781 - DNA, 21 bp, synthetic construct
  misc_feature 1..21: note = n-mer motif encoding polynucleotide
  source 1..21: mol_type = other DNA
aaaaagtcacccagacttgaa

SEQ ID NO: 2782 - DNA, 21 bp, synthetic construct
  misc_feature 1..21: note = n-mer motif encoding polynucleotide
  source 1..21: mol_type = other DNA
acgagcaacacaatgtcagac

SEQ ID NO: 2783 - DNA, 21 bp, synthetic construct
  misc_feature 1..21: note = n-mer motif encoding polynucleotide
  source 1..21: mol_type = other DNA
tctaaaggaaacgaacaaatg

SEQ ID NO: 2784 - DNA, 21 bp, synthetic construct
  misc_feature 1..21: note = n-mer motif encoding polynucleotide
  source 1..21: mol_type = other DNA
ggttacgctacgaccgtgcaa

SEQ ID NO: 2785 - DNA, 21 bp, synthetic construct
  misc_feature 1..21: note = n-mer motif encoding polynucleotide
  source 1..21: mol_type = other DNA
ggatacatgtctaacgtcata

SEQ ID NO: 2786 - DNA, 21 bp, synthetic construct
  misc_feature 1..21: note = n-mer motif encoding polynucleotide
  source 1..21: mol_type = other DNA
gtgactgttagtctggatggg

SEQ ID NO: 2787 - DNA, 21 bp, synthetic construct
  misc_feature 1..21: note = n-mer motif encoding polynucleotide
  source 1..21: mol_type = other DNA
acgaataatttgctggctcag

SEQ ID NO: 2788 - DNA, 21 bp, synthetic construct
  misc_feature 1..21: note = n-mer motif encoding polynucleotide
  source 1..21: mol_type = other DNA
gcgcagacgacggggtatacg

SEQ ID NO: 2789 - DNA, 21 bp, synthetic construct
  misc_feature 1..21: note = n-mer motif encoding polynucleotide
  source 1..21: mol_type = other DNA
agtaagtcgactgagattatg

SEQ ID NO: 2790 - DNA, 21 bp, synthetic construct
  misc_feature 1..21: note = n-mer motif encoding polynucleotide
  source 1..21: mol_type = other DNA
tctgcgatgcacacattagtc

SEQ ID NO: 2791 - DNA, 21 bp, synthetic construct
  misc_feature 1..21: note = n-mer motif encoding polynucleotide
  source 1..21: mol_type = other DNA
gctggggtgcgtgagtcgttt

SEQ ID NO: 2792 - DNA, 21 bp, synthetic construct
  misc_feature 1..21: note = n-mer motif encoding polynucleotide
  source 1..21: mol_type = other DNA
caaggcaactcaatggcgtcc

SEQ ID NO: 2793 - DNA, 21 bp, synthetic construct
  misc_feature 1..21: note = n-mer motif encoding polynucleotide
  source 1..21: mol_type = other DNA
aaaaacccgagtgtccaagaa

SEQ ID NO: 2794 - DNA, 21 bp, synthetic construct
  misc_feature 1..21: note = n-mer motif encoding polynucleotide
  source 1..21: mol_type = other DNA
cccataacacgggaatcggga

SEQ ID NO: 2795 - DNA, 21 bp, synthetic construct
  misc_feature 1..21: note = n-mer motif encoding polynucleotide
  source 1..21: mol_type = other DNA
agccgctcggcagaaatatcg

SEQ ID NO: 2796 - DNA, 21 bp, synthetic construct
  misc_feature 1..21: note = n-mer motif encoding polynucleotide
  source 1..21: mol_type = other DNA
aacgacatccccacacgagcc

SEQ ID NO: 2797 - DNA, 21 bp, synthetic construct
  misc_feature 1..21: note = n-mer motif encoding polynucleotide
  source 1..21: mol_type = other DNA
gcatacggatcgtccggaaga

SEQ ID NO: 2798 - DNA, 21 bp, synthetic construct
  misc_feature 1..21: note = n-mer motif encoding polynucleotide
  source 1..21: mol_type = other DNA
cttcatgggaattttagtcag

SEQ ID NO: 2799 - DNA, 21 bp, synthetic construct
  misc_feature 1..21: note = n-mer motif encoding polynucleotide
  source 1..21: mol_type = other DNA
gcatccaacgggcaagttaac

SEQ ID NO: 2800 - DNA, 21 bp, synthetic construct
  misc_feature 1..21: note = n-mer motif encoding polynucleotide
  source 1..21: mol_type = other DNA
cagaaggggacggttactctg

SEQ ID NO: 2801 - DNA, 21 bp, synthetic construct
  misc_feature 1..21: note = n-mer motif encoding polynucleotide
  source 1..21: mol_type = other DNA
aactctagtaacactggttgg

SEQ ID NO: 2802 - DNA, 21 bp, synthetic construct
  misc_feature 1..21: note = n-mer motif encoding polynucleotide
  source 1..21: mol_type = other DNA
acgtatcagcatcagggtccg

SEQ ID NO: 2803 - DNA, 21 bp, synthetic construct
  misc_feature 1..21: note = n-mer motif encoding polynucleotide
  source 1..21: mol_type = other DNA
gacggggtcgcacaccgctca

SEQ ID NO: 2804 - DNA, 21 bp, synthetic construct
  misc_feature 1..21: note = n-mer motif encoding polynucleotide
  source 1..21: mol_type = other DNA
gacgggctcacgctggaacgc

SEQ ID NO: 2805 - DNA, 21 bp, synthetic construct
  misc_feature 1..21: note = n-mer motif encoding polynucleotide
  source 1..21: mol_type = other DNA
aggggtgatctatctacgcct

SEQ ID NO: 2806 - DNA, 21 bp, synthetic construct
  misc_feature 1..21: note = n-mer motif encoding polynucleotide
  source 1..21: mol_type = other DNA
attaatgagattggtaggatg

SEQ ID NO: 2807 - DNA, 21 bp, synthetic construct
  misc_feature 1..21: note = n-mer motif encoding polynucleotide
  source 1..21: mol_type = other DNA
ccccaatggggaactgacccg

SEQ ID NO: 2808 - DNA, 21 bp, synthetic construct
  misc_feature 1..21: note = n-mer motif encoding polynucleotide
  source 1..21: mol_type = other DNA
aagcaggtggcgcatattgat

SEQ ID NO: 2809 - DNA, 21 bp, synthetic construct
  misc_feature 1..21: note = n-mer motif encoding polynucleotide
  source 1..21: mol_type = other DNA
aatactttgcagaatagtcat

SEQ ID NO: 2810 - DNA, 21 bp, synthetic construct
  misc_feature 1..21: note = n-mer motif encoding polynucleotide
  source 1..21: mol_type = other DNA
tggagccaagggaacacagcg

SEQ ID NO: 2811 - DNA, 21 bp, synthetic construct
  misc_feature 1..21: note = n-mer motif encoding polynucleotide
  source 1..21: mol_type = other DNA
aacgaaacgcacgtacctaaa

SEQ ID NO: 2812 - DNA, 21 bp, synthetic construct
  misc_feature 1..21: note = n-mer motif encoding polynucleotide
  source 1..21: mol_type = other DNA
gtaacgaacgaatcccgcgcc

SEQ ID NO: 2813 - DNA, 21 bp, synthetic construct
  misc_feature 1..21: note = n-mer motif encoding polynucleotide
  source 1..21: mol_type = other DNA
cccgaaggccacatgcaagac

SEQ ID NO: 2814 - DNA, 21 bp, synthetic construct
  misc_feature 1..21: note = n-mer motif encoding polynucleotide
  source 1..21: mol_type = other DNA
ttggattcgactaattctagg

SEQ ID NO: 2815 - DNA, 21 bp, synthetic construct
  misc_feature 1..21: note = n-mer motif encoding polynucleotide
  source 1..21: mol_type = other DNA
cagtcgattgggcatccggtg

SEQ ID NO: 2816 - DNA, 21 bp, synthetic construct
  misc_feature 1..21: note = n-mer motif encoding polynucleotide
  source 1..21: mol_type = other DNA
gtcctggttaacgtacacaac

SEQ ID NO: 2817 - DNA, 21 bp, synthetic construct
  misc_feature 1..21: note = n-mer motif encoding polynucleotide
  source 1..21: mol_type = other DNA
gtgcataatcctactactacg

SEQ ID NO: 2818 - DNA, 21 bp, synthetic construct
  misc_feature 1..21: note = n-mer motif encoding polynucleotide
  source 1..21: mol_type = other DNA
ggggataaggcgagtttggcg

SEQ ID NO: 2819 - DNA, 21 bp, synthetic construct
  misc_feature 1..21: note = n-mer motif encoding polynucleotide
  source 1..21: mol_type = other DNA
ctaaacgaatcccgagcgtcg

SEQ ID NO: 2820 - DNA, 21 bp, synthetic construct
  misc_feature 1..21: note = n-mer motif encoding polynucleotide
  source 1..21: mol_type = other DNA
ggttttcatattaatggtgag

SEQ ID NO: 2821 - DNA, 21 bp, synthetic construct
  misc_feature 1..21: note = n-mer motif encoding polynucleotide
  source 1..21: mol_type = other DNA
agtgttagttctgtggtgttg

SEQ ID NO: 2822 - DNA, 21 bp, synthetic construct
  misc_feature 1..21: note = n-mer motif encoding polynucleotide
  source 1..21: mol_type = other DNA
ctttcgactacttcgacgaag

SEQ ID NO: 2823 - DNA, 21 bp, synthetic construct
  misc_feature 1..21: note = n-mer motif encoding polynucleotide
  source 1..21: mol_type = other DNA
actaatacgcagaataatccg

SEQ ID NO: 2824 - DNA, 21 bp, synthetic construct
  misc_feature 1..21: note = n-mer motif encoding polynucleotide
  source 1..21: mol_type = other DNA
actaatcttgctgttacgctg

SEQ ID NO: 2825 - DNA, 21 bp, synthetic construct
  misc_feature 1..21: note = n-mer motif encoding polynucleotide
  source 1..21: mol_type = other DNA
atgtcggatcgtacttctgat

SEQ ID NO: 2826 - DNA, 21 bp, synthetic construct
  misc_feature 1..21: note = n-mer motif encoding polynucleotide
  source 1..21: mol_type = other DNA
tccgcgcaatctttcgtagtt

SEQ ID NO: 2827 - DNA, 21 bp, synthetic construct
  misc_feature 1..21: note = n-mer motif encoding polynucleotide
  source 1..21: mol_type = other DNA
atgcacacaagtagaccccca

SEQ ID NO: 2828 - DNA, 21 bp, synthetic construct
  misc_feature 1..21: note = n-mer motif encoding polynucleotide
  source 1..21: mol_type = other DNA
atgtctagccacacagtccaa

SEQ ID NO: 2829 - DNA, 21 bp, synthetic construct
  misc_feature 1..21: note = n-mer motif encoding polynucleotide
  source 1..21: mol_type = other DNA
agggatacggctaagggggtg

SEQ ID NO: 2830 - DNA, 21 bp, synthetic construct
  misc_feature 1..21: note = n-mer motif encoding polynucleotide
  source 1..21: mol_type = other DNA
gcgttaaaatccgacagcgcc

SEQ ID NO: 2831 - DNA, 21 bp, synthetic construct
  misc_feature 1..21: note = n-mer motif encoding polynucleotide
  source 1..21: mol_type = other DNA
caatacgacgccagccgacaa

SEQ ID NO: 2832 - DNA, 21 bp, synthetic construct
  misc_feature 1..21: note = n-mer motif encoding polynucleotide
  source 1..21: mol_type = other DNA
ttagccgactcaaacagcaaa

SEQ ID NO: 2833 - DNA, 21 bp, synthetic construct
  misc_feature 1..21: note = n-mer motif encoding polynucleotide
  source 1..21: mol_type = other DNA
tttcagttggctagtaatccg

SEQ ID NO: 2834 - DNA, 21 bp, synthetic construct
  misc_feature 1..21: note = n-mer motif encoding polynucleotide
  source 1..21: mol_type = other DNA
aactctgtcgtagggaacatc

SEQ ID NO: 2835 - DNA, 21 bp, synthetic construct
  misc_feature 1..21: note = n-mer motif encoding polynucleotide
  source 1..21: mol_type = other DNA
aggtatgagagtactagtgct

SEQ ID NO: 2836 - DNA, 21 bp, synthetic construct
  misc_feature 1..21: note = n-mer motif encoding polynucleotide
  source 1..21: mol_type = other DNA
gcggatcataatcatattgct

SEQ ID NO: 2837 - DNA, 21 bp, synthetic construct
  misc_feature 1..21: note = n-mer motif encoding polynucleotide
  source 1..21: mol_type = other DNA
gtaggcgaccaatcccgcccg

SEQ ID NO: 2838 - DNA, 21 bp, synthetic construct
  misc_feature 1..21: note = n-mer motif encoding polynucleotide
  source 1..21: mol_type = other DNA
ttcaacgaaactgccgggcga

SEQ ID NO: 2839 - DNA, 21 bp, synthetic construct
  misc_feature 1..21: note = n-mer motif encoding polynucleotide
  source 1..21: mol_type = other DNA
agcaactcgtacttactcaac

SEQ ID NO: 2840 - DNA, 21 bp, synthetic construct
  misc_feature 1..21: note = n-mer motif encoding polynucleotide
  source 1..21: mol_type = other DNA
cgaggcgacacaaagaactac

SEQ ID NO: 2841 - DNA, 21 bp, synthetic construct
  misc_feature 1..21: note = n-mer motif encoding polynucleotide
  source 1..21: mol_type = other DNA
acgactactactatggcatac

SEQ ID NO: 2842 - DNA, 21 bp, synthetic construct
  misc_feature 1..21: note = n-mer motif encoding polynucleotide
  source 1..21: mol_type = other DNA
cgacccccgaacgaaaacaga

SEQ ID NO: 2843 - DNA, 21 bp, synthetic construct
  misc_feature 1..21: note = n-mer motif encoding polynucleotide
  source 1..21: mol_type = other DNA
tgcgccaacatgaccaacggc

SEQ ID NO: 2844 - DNA, 21 bp, synthetic construct
  misc_feature 1..21: note = n-mer motif encoding polynucleotide
  source 1..21: mol_type = other DNA
aatcggtcggatagttttgcg

SEQ ID NO: 2845 - DNA, 21 bp, synthetic construct
  misc_feature 1..21: note = n-mer motif encoding polynucleotide
  source 1..21: mol_type = other DNA
aatcttttgacttcgtcgcct

SEQ ID NO: 2846 - DNA, 21 bp, synthetic construct
  misc_feature 1..21: note = n-mer motif encoding polynucleotide
  source 1..21: mol_type = other DNA
aactccagggaaatgggtgta

SEQ ID NO: 2847 - DNA, 21 bp, synthetic construct
  misc_feature 1..21: note = n-mer motif encoding polynucleotide
  source 1..21: mol_type = other DNA
atggggaatcagagtggtgcg

SEQ ID NO: 2848 - DNA, 21 bp, synthetic construct
  misc_feature 1..21: note = n-mer motif encoding polynucleotide
  source 1..21: mol_type = other DNA
atgctcacagaaaccaaagca

SEQ ID NO: 2849 - DNA, 21 bp, synthetic construct
  misc_feature 1..21: note = n-mer motif encoding polynucleotide
  source 1..21: mol_type = other DNA
caaaacatcaaaaacatgaca

SEQ ID NO: 2850 - DNA, 21 bp, synthetic construct
  misc_feature 1..21: note = n-mer motif encoding polynucleotide
  source 1..21: mol_type = other DNA
atgagtacggttcttcgcgag

SEQ ID NO: 2851 - DNA, 21 bp, synthetic construct
  misc_feature 1..21: note = n-mer motif encoding polynucleotide
  source 1..21: mol_type = other DNA
gaccgtgcccaaaacaacgaa

SEQ ID NO: 2852 - DNA, 21 bp, synthetic construct
  misc_feature 1..21: note = n-mer motif encoding polynucleotide
  source 1..21: mol_type = other DNA
catacgcagtcgacgggttat

SEQ ID NO: 2853 - DNA, 21 bp, synthetic construct
  misc_feature 1..21: note = n-mer motif encoding polynucleotide
  source 1..21: mol_type = other DNA
atgagtgtggggaaggtttat

SEQ ID NO: 2854 - DNA, 21 bp, synthetic construct
  misc_feature 1..21: note = n-mer motif encoding polynucleotide
  source 1..21: mol_type = other DNA
gccggaaactaccaatcatca

SEQ ID NO: 2855 - DNA, 21 bp, synthetic construct
  misc_feature 1..21: note = n-mer motif encoding polynucleotide
  source 1..21: mol_type = other DNA
agaaacgaaaacgtaaacgct

SEQ ID NO: 2856 - DNA, 21 bp, synthetic construct
  misc_feature 1..21: note = n-mer motif encoding polynucleotide
  source 1..21: mol_type = other DNA
gacacccaccacacatccagt

SEQ ID NO: 2857 - DNA, 21 bp, synthetic construct
  misc_feature 1..21: note = n-mer motif encoding polynucleotide
  source 1..21: mol_type = other DNA
actagctcccctgttctacaa

SEQ ID NO: 2858 - DNA, 21 bp, synthetic construct
  misc_feature 1..21: note = n-mer motif encoding polynucleotide
  source 1..21: mol_type = other DNA
gtgggccgtgacgcagaagct

SEQ ID NO: 2859 - DNA, 21 bp, synthetic construct
  misc_feature 1..21: note = n-mer motif encoding polynucleotide
  source 1..21: mol_type = other DNA
aacatggaaagaggatcgcaa

SEQ ID NO: 2860 - DNA, 21 bp, synthetic construct
  misc_feature 1..21: note = n-mer motif encoding polynucleotide
  source 1..21: mol_type = other DNA
gacagacaaacaggccaaaaa

SEQ ID NO: 2861 - DNA, 21 bp, synthetic construct
  misc_feature 1..21: note = n-mer motif encoding polynucleotide
  source 1..21: mol_type = other DNA
gtcttccgggaaggcatcgtg

SEQ ID NO: 2862 - DNA, 21 bp, synthetic construct
  misc_feature 1..21: note = n-mer motif encoding polynucleotide
  source 1..21: mol_type = other DNA
tccgcaaacaacatagccacc

SEQ ID NO: 2863 - DNA, 21 bp, synthetic construct
  misc_feature 1..21: note = n-mer motif encoding polynucleotide
  source 1..21: mol_type = other DNA
gtatcagaaggacaacgaatc

SEQ ID NO: 2864 - DNA, 21 bp, synthetic construct
  misc_feature 1..21: note = n-mer motif encoding polynucleotide
  source 1..21: mol_type = other DNA
cactacggtaacaaagacata

SEQ ID NO: 2865 - DNA, 21 bp, synthetic construct
  misc_feature 1..21: note = n-mer motif encoding polynucleotide
  source 1..21: mol_type = other DNA
gatgttttgcttaagaatttt

SEQ ID NO: 2866 - DNA, 21 bp, synthetic construct
  misc_feature 1..21: note = n-mer motif encoding polynucleotide
  source 1..21: mol_type = other DNA
cacacggttcaaatacgcgaa

SEQ ID NO: 2867 - DNA, 21 bp, synthetic construct
  misc_feature 1..21: note = n-mer motif encoding polynucleotide
  source 1..21: mol_type = other DNA
acatcagcactagcacaccaa

SEQ ID NO: 2868 - DNA, 21 bp, synthetic construct
  misc_feature 1..21: note = n-mer motif encoding polynucleotide
  source 1..21: mol_type = other DNA
atcccaaccggccaaactagc

SEQ ID NO: 2869 - DNA, 21 bp, synthetic construct
  misc_feature 1..21: note = n-mer motif encoding polynucleotide
  source 1..21: mol_type = other DNA
cgcagcgacaaaggaacgttg

SEQ ID NO: 2870 - DNA, 21 bp, synthetic construct
  misc_feature 1..21: note = n-mer motif encoding polynucleotide
  source 1..21: mol_type = other DNA
aatggtcttacggttcagcgg

SEQ ID NO: 2871 - DNA, 21 bp, synthetic construct
  misc_feature 1..21: note = n-mer motif encoding polynucleotide
  source 1..21: mol_type = other DNA
acggttgagggttcttatccg

SEQ ID NO: 2872 - DNA, 21 bp, synthetic construct
  misc_feature 1..21: note = n-mer motif encoding polynucleotide
  source 1..21: mol_type = other DNA
actagccacttagtacttgca

SEQ ID NO: 2873 - DNA, 21 bp, synthetic construct
  misc_feature 1..21: note = n-mer motif encoding polynucleotide
  source 1..21: mol_type = other DNA
aatcatagtctgtcggagcat

SEQ ID NO: 2874 - DNA, 21 bp, synthetic construct
  misc_feature 1..21: note = n-mer motif encoding polynucleotide
  source 1..21: mol_type = other DNA
ttaacaggcatgaacagagac

SEQ ID NO: 2875 - DNA, 21 bp, synthetic construct
  misc_feature 1..21: note = n-mer motif encoding polynucleotide
  source 1..21: mol_type = other DNA
agtcacaacgctggggtcgcc

SEQ ID NO: 2876 - DNA, 21 bp, synthetic construct
  misc_feature 1..21: note = n-mer motif encoding polynucleotide
  source 1..21: mol_type = other DNA
gcgcaccaaaccgccgggcca

SEQ ID NO: 2877 - DNA, 21 bp, synthetic construct
  misc_feature 1..21: note = n-mer motif encoding polynucleotide
  source 1..21: mol_type = other DNA
aattctcatgatttgaagtat

SEQ ID NO: 2878 - DNA, 21 bp, synthetic construct
  misc_feature 1..21: note = n-mer motif encoding polynucleotide
  source 1..21: mol_type = other DNA
actacaatgagtaccggtcaa

SEQ ID NO: 2879 - DNA, 21 bp, synthetic construct
  misc_feature 1..21: note = n-mer motif encoding polynucleotide
  source 1..21: mol_type = other DNA
gggttcgggcacgtgcccgaa

SEQ ID NO: 2880 - DNA, 21 bp, synthetic construct
  misc_feature 1..21: note = n-mer motif encoding polynucleotide
  source 1..21: mol_type = other DNA
atcaccgccgcgtcaccgcaa

SEQ ID NO: 2881 - DNA, 21 bp, synthetic construct
  misc_feature 1..21: note = n-mer motif encoding polynucleotide
  source 1..21: mol_type = other DNA
gttaaggcgagtgctggggat

SEQ ID NO: 2882 - DNA, 21 bp, synthetic construct
  misc_feature 1..21: note = n-mer motif encoding polynucleotide
  source 1..21: mol_type = other DNA
agtatcacacacagcaacacc

SEQ ID NO: 2883 - DNA, 21 bp, synthetic construct
  misc_feature 1..21: note = n-mer motif encoding polynucleotide
  source 1..21: mol_type = other DNA
cataataataatatgctgaat

SEQ ID NO: 2884 - DNA, 21 bp, synthetic construct
  misc_feature 1..21: note = n-mer motif encoding polynucleotide
  source 1..21: mol_type = other DNA
cccaaaactctaacttcgaca

SEQ ID NO: 2885 - DNA, 21 bp, synthetic construct
  misc_feature 1..21: note = n-mer motif encoding polynucleotide
  source 1..21: mol_type = other DNA
ataaccggcaacaccgtcgga

SEQ ID NO: 2886 - DNA, 21 bp, synthetic construct
  misc_feature 1..21: note = n-mer motif encoding polynucleotide
  source 1..21: mol_type = other DNA
ctcggaaaccactacacaccc

SEQ ID NO: 2887 - DNA, 21 bp, synthetic construct
  misc_feature 1..21: note = n-mer motif encoding polynucleotide
  source 1..21: mol_type = other DNA
tcgtttactaatacgaatcct

SEQ ID NO: 2888 - DNA, 21 bp, synthetic construct
  misc_feature 1..21: note = n-mer motif encoding polynucleotide
  source 1..21: mol_type = other DNA
acgttggatcggaatcagact

SEQ ID NO: 2889 - DNA, 21 bp, synthetic construct
  misc_feature 1..21: note = n-mer motif encoding polynucleotide
  source 1..21: mol_type = other DNA
atctctacgcaaagaccgcac

SEQ ID NO: 2890 - DNA, 21 bp, synthetic construct
  misc_feature 1..21: note = n-mer motif encoding polynucleotide
  source 1..21: mol_type = other DNA
acattcactactctgggcaaa

SEQ ID NO: 2891 - DNA, 21 bp, synthetic construct
  misc_feature 1..21: note = n-mer motif encoding polynucleotide
  source 1..21: mol_type = other DNA
gagaagccttctcttgtgatg

SEQ ID NO: 2892 - DNA, 21 bp, synthetic construct
  misc_feature 1..21: note = n-mer motif encoding polynucleotide
  source 1..21: mol_type = other DNA
cacatcgaaaccaacacttcg

SEQ ID NO: 2893 - DNA, 21 bp, synthetic construct
  misc_feature 1..21: note = n-mer motif encoding polynucleotide
  source 1..21: mol_type = other DNA
ggtacgaaggatattctgatt

SEQ ID NO: 2894 - DNA, 21 bp, synthetic construct
  misc_feature 1..21: note = n-mer motif encoding polynucleotide
  source 1..21: mol_type = other DNA
gcgacttttagtcatgctggt

SEQ ID NO: 2895 - DNA, 21 bp, synthetic construct
  misc_feature 1..21: note = n-mer motif encoding polynucleotide
  source 1..21: mol_type = other DNA
gccaacggcatattccaaccg

SEQ ID NO: 2896 - DNA, 21 bp, synthetic construct
  misc_feature 1..21: note = n-mer motif encoding polynucleotide
  source 1..21: mol_type = other DNA
cttaatgtgaatacgcttaat

SEQ ID NO: 2897 - DNA, 21 bp, synthetic construct
  misc_feature 1..21: note = n-mer motif encoding polynucleotide
  source 1..21: mol_type = other DNA
acttctgctagtgagaattgg

SEQ ID NO: 2898 - DNA, 21 bp, synthetic construct
  misc_feature 1..21: note = n-mer motif encoding polynucleotide
  source 1..21: mol_type = other DNA
cttcttcagggtgcgactaag

SEQ ID NO: 2899 - DNA, 21 bp, synthetic construct
  misc_feature 1..21: note = n-mer motif encoding polynucleotide
  source 1..21: mol_type = other DNA
gctcttgagactactcgtgct

SEQ ID NO: 2900 - DNA, 21 bp, synthetic construct
  misc_feature 1..21: note = n-mer motif encoding polynucleotide
  source 1..21: mol_type = other DNA
ttaacgggacaaaacgaattc

SEQ ID NO: 2901 - DNA, 21 bp, synthetic construct
  misc_feature 1..21: note = n-mer motif encoding polynucleotide
  source 1..21: mol_type = other DNA
atttctcatgatttgaagaat

SEQ ID NO: 2902 - DNA, 21 bp, synthetic construct
  misc_feature 1..21: note = n-mer motif encoding polynucleotide
  source 1..21: mol_type = other DNA
gcacaatacaacaacggcgta

SEQ ID NO: 2903 - DNA, 21 bp, synthetic construct
  misc_feature 1..21: note = n-mer motif encoding polynucleotide
  source 1..21: mol_type = other DNA
acgacgtctgtggagaagact

SEQ ID NO: 2904 - DNA, 21 bp, synthetic construct
  misc_feature 1..21: note = n-mer motif encoding polynucleotide
  source 1..21: mol_type = other DNA
ggtacgtcggctattatgcct

SEQ ID NO: 2905 - DNA, 21 bp, synthetic construct
  misc_feature 1..21: note = n-mer motif encoding polynucleotide
  source 1..21: mol_type = other DNA
cagctgcaggggactgaggcg

SEQ ID NO: 2906 - DNA, 21 bp, synthetic construct
  misc_feature 1..21: note = n-mer motif encoding polynucleotide
  source 1..21: mol_type = other DNA
gccttaaaatcccaagaacca

SEQ ID NO: 2907 - DNA, 21 bp, synthetic construct
  misc_feature 1..21: note = n-mer motif encoding polynucleotide
  source 1..21: mol_type = other DNA
tctaacagcagtgttgcggta

SEQ ID NO: 2908 - DNA, 21 bp, synthetic construct
  misc_feature 1..21: note = n-mer motif encoding polynucleotide
  source 1..21: mol_type = other DNA
aatcatggtcgtgctattgat

SEQ ID NO: 2909 - DNA, 21 bp, synthetic construct
  misc_feature 1..21: note = n-mer motif encoding polynucleotide
  source 1..21: mol_type = other DNA
gatacgtataatagtaatact

SEQ ID NO: 2910 - DNA, 21 bp, synthetic construct
  misc_feature 1..21: note = n-mer motif encoding polynucleotide
  source 1..21: mol_type = other DNA
acattccaccaagcggtcaaa

SEQ ID NO: 2911 - DNA, 21 bp, synthetic construct
  misc_feature 1..21: note = n-mer motif encoding polynucleotide
  source 1..21: mol_type = other DNA
tggcatactggtgtgtttcag

SEQ ID NO: 2912 - DNA, 21 bp, synthetic construct
  misc_feature 1..21: note = n-mer motif encoding polynucleotide
  source 1..21: mol_type = other DNA
aggggtgatctttctacgcca

SEQ ID NO: 2913 - DNA, 21 bp, synthetic construct
  misc_feature 1..21: note = n-mer motif encoding polynucleotide
  source 1..21: mol_type = other DNA
atgcttagtcaggttctgacg

SEQ ID NO: 2914 - DNA, 21 bp, synthetic construct
  misc_feature 1..21: note = n-mer motif encoding polynucleotide
  source 1..21: mol_type = other DNA
gaaaacgaaaaacgagaaagc

SEQ ID NO: 2915 - DNA, 21 bp, synthetic construct
  misc_feature 1..21: note = n-mer motif encoding polynucleotide
  source 1..21: mol_type = other DNA
atttcgagttatgatggtaat

SEQ ID NO: 2916 - DNA, 21 bp, synthetic construct
  misc_feature 1..21: note = n-mer motif encoding polynucleotide
  source 1..21: mol_type = other DNA
actcgtggcgacatggaattc

SEQ ID NO: 2917 - DNA, 21 bp, synthetic construct
  misc_feature 1..21: note = n-mer motif encoding polynucleotide
  source 1..21: mol_type = other DNA
aatgtgcagaatgtgcctggg

SEQ ID NO: 2918 - DNA, 21 bp, synthetic construct
  misc_feature 1..21: note = n-mer motif encoding polynucleotide
  source 1..21: mol_type = other DNA
tctttcacgaacacaaaccca

SEQ ID NO: 2919 - DNA, 21 bp, synthetic construct
  misc_feature 1..21: note = n-mer motif encoding polynucleotide
  source 1..21: mol_type = other DNA
tcgaacgctggctaccactcg

SEQ ID NO: 2920 - DNA, 21 bp, synthetic construct
  misc_feature 1..21: note = n-mer motif encoding polynucleotide
  source 1..21: mol_type = other DNA
gactacaaaaacagcgcgcca

SEQ ID NO: 2921 - DNA, 21 bp, synthetic construct
  misc_feature 1..21: note = n-mer motif encoding polynucleotide
  source 1..21: mol_type = other DNA
gtcgggaaaaactcgtacgaa

SEQ ID NO: 2922 - DNA, 21 bp, synthetic construct
  misc_feature 1..21: note = n-mer motif encoding polynucleotide
  source 1..21: mol_type = other DNA
gcttacgcaggtgtacttggg

SEQ ID NO: 2923 - DNA, 21 bp, synthetic construct
  misc_feature 1..21: note = n-mer motif encoding polynucleotide
  source 1..21: mol_type = other DNA
acgacgtctgagcgtgtgaat

SEQ ID NO: 2924 - DNA, 21 bp, synthetic construct
  misc_feature 1..21: note = n-mer motif encoding polynucleotide
  source 1..21: mol_type = other DNA
gacaccggaatcaaaaacgtt

SEQ ID NO: 2925 - DNA, 21 bp, synthetic construct
  misc_feature 1..21: note = n-mer motif encoding polynucleotide
  source 1..21: mol_type = other DNA
tcgaccagctctctggttccc

SEQ ID NO: 2926 - DNA, 21 bp, synthetic construct
  misc_feature 1..21: note = n-mer motif encoding polynucleotide
  source 1..21: mol_type = other DNA
tggagcgccggcgaacgggtg

SEQ ID NO: 2927 - DNA, 21 bp, synthetic construct
  misc_feature 1..21: note = n-mer motif encoding polynucleotide
  source 1..21: mol_type = other DNA
agttcggggagtttgattact

SEQ ID NO: 2928 - DNA, 21 bp, synthetic construct
  misc_feature 1..21: note = n-mer motif encoding polynucleotide
  source 1..21: mol_type = other DNA
tggatttctactgagatgagg

SEQ ID NO: 2929 - DNA, 21 bp, synthetic construct
  misc_feature 1..21: note = n-mer motif encoding polynucleotide
  source 1..21: mol_type = other DNA
tttgcggctggggcgcatggt

SEQ ID NO: 2930 - DNA, 21 bp, synthetic construct
  misc_feature 1..21: note = n-mer motif encoding polynucleotide
  source 1..21: mol_type = other DNA
ataggcgaccgcgaccaacgt

SEQ ID NO: 2931 - DNA, 21 bp, synthetic construct
  misc_feature 1..21: note = n-mer motif encoding polynucleotide
  source 1..21: mol_type = other DNA
agtacgattggtaattctact

SEQ ID NO: 2932 - DNA, 21 bp, synthetic construct
  misc_feature 1..21: note = n-mer motif encoding polynucleotide
  source 1..21: mol_type = other DNA
ggaagtggcaccgtcggtcga

SEQ ID NO: 2933 - DNA, 21 bp, synthetic construct
  misc_feature 1..21: note = n-mer motif encoding polynucleotide
  source 1..21: mol_type = other DNA
catgttacggcggtggttgat

SEQ ID NO: 2934 - DNA, 21 bp, synthetic construct
  misc_feature 1..21: note = n-mer motif encoding polynucleotide
  source 1..21: mol_type = other DNA
gataaggcgggggtggctaat

SEQ ID NO: 2935 - DNA, 21 bp, synthetic construct
  misc_feature 1..21: note = n-mer motif encoding polynucleotide
  source 1..21: mol_type = other DNA
cgtctgactgatactatgcat

SEQ ID NO: 2936 - DNA, 21 bp, synthetic construct
  misc_feature 1..21: note = n-mer motif encoding polynucleotide
  source 1..21: mol_type = other DNA
ctgaacactctaatccacaaa

SEQ ID NO: 2937 - DNA, 21 bp, synthetic construct
  misc_feature 1..21: note = n-mer motif encoding polynucleotide
  source 1..21: mol_type = other DNA
agttatcagaatcctccgcct

SEQ ID NO: 2938 - DNA, 21 bp, synthetic construct
  misc_feature 1..21: note = n-mer motif encoding polynucleotide
  source 1..21: mol_type = other DNA
ttgacaggattaaacgctttc

SEQ ID NO: 2939 - DNA, 21 bp, synthetic construct
  misc_feature 1..21: note = n-mer motif encoding polynucleotide
  source 1..21: mol_type = other DNA
agtcctgtgctttctccttcg

SEQ ID NO: 2940 - DNA, 21 bp, synthetic construct
  misc_feature 1..21: note = n-mer motif encoding polynucleotide
  source 1..21: mol_type = other DNA
gttcaaacacacataggagtc

SEQ ID NO: 2941 - DNA, 21 bp, synthetic construct
  misc_feature 1..21: note = n-mer motif encoding polynucleotide
  source 1..21: mol_type = other DNA
catatgtcttctgttgcgact

SEQ ID NO: 2942 - DNA, 21 bp, synthetic construct
  misc_feature 1..21: note = n-mer motif encoding polynucleotide
  source 1..21: mol_type = other DNA
ggaaaagccaacgacggttct

SEQ ID NO: 2943 - DNA, 21 bp, synthetic construct
  misc_feature 1..21: note = n-mer motif encoding polynucleotide
  source 1..21: mol_type = other DNA
agtactaacgacgaacgcaaa

SEQ ID NO: 2944 - DNA, 21 bp, synthetic construct
  misc_feature 1..21: note = n-mer motif encoding polynucleotide
  source 1..21: mol_type = other DNA
cagggggggaatagtcggttt

SEQ ID NO: 2945 - DNA, 21 bp, synthetic construct
  misc_feature 1..21: note = n-mer motif encoding polynucleotide
  source 1..21: mol_type = other DNA
cctaacaacgaaaaaaacccg

SEQ ID NO: 2946 - DNA, 21 bp, synthetic construct
  misc_feature 1..21: note = n-mer motif encoding polynucleotide
  source 1..21: mol_type = other DNA
gtggctgcgacgggtggtact

SEQ ID NO: 2947 - DNA, 21 bp, synthetic construct
  misc_feature 1..21: note = n-mer motif encoding polynucleotide
  source 1..21: mol_type = other DNA
gcgattgtggatagggggagt

SEQ ID NO: 2948 - DNA, 21 bp, synthetic construct
  misc_feature 1..21: note = n-mer motif encoding polynucleotide
  source 1..21: mol_type = other DNA
tcccaacaccacacgccactg

SEQ ID NO: 2949 - DNA, 21 bp, synthetic construct
  misc_feature 1..21: note = n-mer motif encoding polynucleotide
  source 1..21: mol_type = other DNA
ttacaaagctcgatgaacgta

SEQ ID NO: 2950 - DNA, 21 bp, synthetic construct
  misc_feature 1..21: note = n-mer motif encoding polynucleotide
  source 1..21: mol_type = other DNA
cgagaaaccaacccgtctgaa

SEQ ID NO: 2951 - DNA, 21 bp, synthetic construct
  misc_feature 1..21: note = n-mer motif encoding polynucleotide
  source 1..21: mol_type = other DNA
gggttcgggcacctgcccgaa

SEQ ID NO: 2952 - DNA, 21 bp, synthetic construct
  misc_feature 1..21: note = n-mer motif encoding polynucleotide
  source 1..21: mol_type = other DNA
cggaatgctactgtgactgtt

SEQ ID NO: 2953 - DNA, 21 bp, synthetic construct
  misc_feature 1..21: note = n-mer motif encoding polynucleotide
  source 1..21: mol_type = other DNA
gtttcaaacgcttcgggctta

SEQ ID NO: 2954 - DNA, 21 bp, synthetic construct
  misc_feature 1..21: note = n-mer motif encoding polynucleotide
  source 1..21: mol_type = other DNA
gatcgtccgaataatgagtcg

SEQ ID NO: 2955 - DNA, 21 bp, synthetic construct
  misc_feature 1..21: note = n-mer motif encoding polynucleotide
  source 1..21: mol_type = other DNA
caggttagtctggtgaagttg

SEQ ID NO: 2956 - DNA, 21 bp, synthetic construct
  misc_feature 1..21: note = n-mer motif encoding polynucleotide
  source 1..21: mol_type = other DNA
agtaatatgcgtgaggagatt

SEQ ID NO: 2957 - DNA, 21 bp, synthetic construct
  misc_feature 1..21: note = n-mer motif encoding polynucleotide
  source 1..21: mol_type = other DNA
gatattgggcgttcgaatagt

SEQ ID NO: 2958 - DNA, 21 bp, synthetic construct
  misc_feature 1..21: note = n-mer motif encoding polynucleotide
  source 1..21: mol_type = other DNA
gatcatatgaatttgaggtct

SEQ ID NO: 2959 - DNA, 21 bp, synthetic construct
  misc_feature 1..21: note = n-mer motif encoding polynucleotide
  source 1..21: mol_type = other DNA
attgagcgtagtagtgatcgt

SEQ ID NO: 2960 - DNA, 21 bp, synthetic construct
  misc_feature 1..21: note = n-mer motif encoding polynucleotide
  source 1..21: mol_type = other DNA
ttgtctcagaattttaatcct

SEQ ID NO: 2961 - DNA, 21 bp, synthetic construct
  misc_feature 1..21: note = n-mer motif encoding polynucleotide
  source 1..21: mol_type = other DNA
tattctatgggtcagcagccg

SEQ ID NO: 2962 - DNA, 21 bp, synthetic construct
  misc_feature 1..21: note = n-mer motif encoding polynucleotide
  source 1..21: mol_type = other DNA
tacacacaagggataatgaac

SEQ ID NO: 2963 - DNA, 21 bp, synthetic construct
  misc_feature 1..21: note = n-mer motif encoding polynucleotide
  source 1..21: mol_type = other DNA
atgctgtctcatggtgcgctt

SEQ ID NO: 2964 - DNA, 21 bp, synthetic construct
  misc_feature 1..21: note = n-mer motif encoding polynucleotide
  source 1..21: mol_type = other DNA
gcttataatgctcgtctgcct

SEQ ID NO: 2965 - DNA, 21 bp, synthetic construct
  misc_feature 1..21: note = n-mer motif encoding polynucleotide
  source 1..21: mol_type = other DNA
agacactactccgacaacgcc

SEQ ID NO: 2966 - DNA, 21 bp, synthetic construct
  misc_feature 1..21: note = n-mer motif encoding polynucleotide
  source 1..21: mol_type = other DNA
gcacacacagccatgacctac

SEQ ID NO: 2967 - DNA, 21 bp, synthetic construct
  misc_feature 1..21: note = n-mer motif encoding polynucleotide
  source 1..21: mol_type = other DNA
ctaacaggctctgacatgaaa

SEQ ID NO: 2968 - DNA, 21 bp, synthetic construct
  misc_feature 1..21: note = n-mer motif encoding polynucleotide
  source 1..21: mol_type = other DNA
accttacacacgaaagacttg

SEQ ID NO: 2969 - DNA, 21 bp, synthetic construct
  misc_feature 1..21: note = n-mer motif encoding polynucleotide
  source 1..21: mol_type = other DNA
tcgggtcaaaacggtacatca

SEQ ID NO: 2970 - DNA, 21 bp, synthetic construct
  misc_feature 1..21: note = n-mer motif encoding polynucleotide
  source 1..21: mol_type = other DNA
cgtggggacgtccacaccaac

SEQ ID NO: 2971 - DNA, 21 bp, synthetic construct
  misc_feature 1..21: note = n-mer motif encoding polynucleotide
  source 1..21: mol_type = other DNA
accggaacggctacactccca

SEQ ID NO: 2972 - DNA, 21 bp, synthetic construct
  misc_feature 1..21: note = n-mer motif encoding polynucleotide
  source 1..21: mol_type = other DNA
ctgggtacgctgcttagtcag

SEQ ID NO: 2973 - DNA, 21 bp, synthetic construct
  misc_feature 1..21: note = n-mer motif encoding polynucleotide
  source 1..21: mol_type = other DNA
gtcctctcctccaacctgtac

SEQ ID NO: 2974 - DNA, 21 bp, synthetic construct
  misc_feature 1..21: note = n-mer motif encoding polynucleotide
  source 1..21: mol_type = other DNA
agtttggggtcggatcgtatg

SEQ ID NO: 2975 - DNA, 21 bp, synthetic construct
  misc_feature 1..21: note = n-mer motif encoding polynucleotide
  source 1..21: mol_type = other DNA
aggggagatctttctacgcct

SEQ ID NO: 2976 - DNA, 21 bp, synthetic construct
  misc_feature 1..21: note = n-mer motif encoding polynucleotide
  source 1..21: mol_type = other DNA
aggatgtcggagagttctgat

SEQ ID NO: 2977 - DNA, 21 bp, synthetic construct
  misc_feature 1..21: note = n-mer motif encoding polynucleotide
  source 1..21: mol_type = other DNA
atgactgagaaggcttctatt

SEQ ID NO: 2978 - DNA, 21 bp, synthetic construct
  misc_feature 1..21: note = n-mer motif encoding polynucleotide
  source 1..21: mol_type = other DNA
acagaacaatcttactaacga

SEQ ID NO: 2979 - DNA, 21 bp, synthetic construct
  misc_feature 1..21: note = n-mer motif encoding polynucleotide
  source 1..21: mol_type = other DNA
gttgaatctaaatccgaacca

SEQ ID NO: 2980 - DNA, 21 bp, synthetic construct
  misc_feature 1..21: note = n-mer motif encoding polynucleotide
  source 1..21: mol_type = other DNA
atgaatcttgtgagggattcg

SEQ ID NO: 2981 - DNA, 21 bp, synthetic construct
  misc_feature 1..21: note = n-mer motif encoding polynucleotide
  source 1..21: mol_type = other DNA
caaaaccactctataacaaca

SEQ ID NO: 2982 - DNA, 21 bp, synthetic construct
  misc_feature 1..21: note = n-mer motif encoding polynucleotide
  source 1..21: mol_type = other DNA
acgctggacaacaaccacagc

SEQ ID NO: 2983 - DNA, 21 bp, synthetic construct
  misc_feature 1..21: note = n-mer motif encoding polynucleotide
  source 1..21: mol_type = other DNA
acgaagagttttaatgatctt

SEQ ID NO: 2984 - DNA, 21 bp, synthetic construct
  misc_feature 1..21: note = n-mer motif encoding polynucleotide
  source 1..21: mol_type = other DNA
gccacagaacactcagggcgc

SEQ ID NO: 2985 - DNA, 21 bp, synthetic construct
  misc_feature 1..21: note = n-mer motif encoding polynucleotide
  source 1..21: mol_type = other DNA
caagggactctcttgtctcca

SEQ ID NO: 2986 - DNA, 21 bp, synthetic construct
  misc_feature 1..21: note = n-mer motif encoding polynucleotide
  source 1..21: mol_type = other DNA
acattccaccaaggggtcaaa

SEQ ID NO: 2987 - DNA, 21 bp, synthetic construct
  misc_feature 1..21: note = n-mer motif encoding polynucleotide
  source 1..21: mol_type = other DNA
tgtcagcgggctgattgtgcg

SEQ ID NO: 2988 - DNA, 21 bp, synthetic construct
  misc_feature 1..21: note = n-mer motif encoding polynucleotide
  source 1..21: mol_type = other DNA
cggtatgatggtactcttaat

SEQ ID NO: 2989 - DNA, 21 bp, synthetic construct
  misc_feature 1..21: note = n-mer motif encoding polynucleotide
  source 1..21: mol_type = other DNA
caaggcggtacaaacaacccc

SEQ ID NO: 2990 - DNA, 21 bp, synthetic construct
  misc_feature 1..21: note = n-mer motif encoding polynucleotide
  source 1..21: mol_type = other DNA
gggggtaactaccacaccact

SEQ ID NO: 2991 - DNA, 21 bp, synthetic construct
  misc_feature 1..21: note = n-mer motif encoding polynucleotide
  source 1..21: mol_type = other DNA
ctggttgttcagagtgcgcag

SEQ ID NO: 2992 - DNA, 21 bp, synthetic construct
  misc_feature 1..21: note = n-mer motif encoding polynucleotide
  source 1..21: mol_type = other DNA
tatcctcatgagagtaagaat

SEQ ID NO: 2993 - DNA, 21 bp, synthetic construct
  misc_feature 1..21: note = n-mer motif encoding polynucleotide
  source 1..21: mol_type = other DNA
gagattgttaggcatacgcat

SEQ ID NO: 2994 - DNA, 21 bp, synthetic construct
  misc_feature 1..21: note = n-mer motif encoding polynucleotide
  source 1..21: mol_type = other DNA
gaccggacaaacaacatgagc

SEQ ID NO: 2995 - DNA, 21 bp, synthetic construct
  misc_feature 1..21: note = n-mer motif encoding polynucleotide
  source 1..21: mol_type = other DNA
tccgtaaccaacggagcggaa

SEQ ID NO: 2996 - DNA, 21 bp, synthetic construct
  misc_feature 1..21: note = n-mer motif encoding polynucleotide
  source 1..21: mol_type = other DNA
agcggacaaaaaaactcagaa

SEQ ID NO: 2997 - DNA, 21 bp, synthetic construct
  misc_feature 1..21: note = n-mer motif encoding polynucleotide
  source 1..21: mol_type = other DNA
gagcagaagaagactgatcat

SEQ ID NO: 2998 - DNA, 21 bp, synthetic construct
  misc_feature 1..21: note = n-mer motif encoding polynucleotide
  source 1..21: mol_type = other DNA
aatattaatggtggggggaat

SEQ ID NO: 2999 - DNA, 21 bp, synthetic construct
  misc_feature 1..21: note = n-mer motif encoding polynucleotide
  source 1..21: mol_type = other DNA
aagctgcatactaaggatctt

SEQ ID NO: 3000 - DNA, 21 bp, synthetic construct
  misc_feature 1..21: note = n-mer motif encoding polynucleotide
  source 1..21: mol_type = other DNA
agcttcttggtagcccaccca

SEQ ID NO: 3001 - DNA, 21 bp, synthetic construct
  misc_feature 1..21: note = n-mer motif encoding polynucleotide
  source 1..21: mol_type = other DNA
taccaacaaaacatagaaatc

SEQ ID NO: 3002 - DNA, 21 bp, synthetic construct
  misc_feature 1..21: note = n-mer motif encoding polynucleotide
  source 1..21: mol_type = other DNA
aggggtgatctttctacgact

SEQ ID NO: 3003 - DNA, 21 bp, synthetic construct
  misc_feature 1..21: note = n-mer motif encoding polynucleotide
  source 1..21: mol_type = other DNA
gcgaacctcaacttgaccagt

SEQ ID NO: 3004 - DNA, 21 bp, synthetic construct
  misc_feature 1..21: note = n-mer motif encoding polynucleotide
  source 1..21: mol_type = other DNA
acggtgcagcatgcggcgacg

SEQ ID NO: 3005 - DNA, 21 bp, synthetic construct
  misc_feature 1..21: note = n-mer motif encoding polynucleotide
  source 1..21: mol_type = other DNA
accgtaaacctcctagcggca

SEQ ID NO: 3006 - DNA, 21 bp, synthetic construct
  misc_feature 1..21: note = n-mer motif encoding polynucleotide
  source 1..21: mol_type = other DNA
aaccaaagagttgaacaaaaa

SEQ ID NO: 3007 - DNA, 21 bp, synthetic construct
  misc_feature 1..21: note = n-mer motif encoding polynucleotide
  source 1..21: mol_type = other DNA
aatacttatactgctgcgaag

SEQ ID NO: 3008 - DNA, 21 bp, synthetic construct
  misc_feature 1..21: note = n-mer motif encoding polynucleotide
  source 1..21: mol_type = other DNA
atccaaagagacgtgggccac

SEQ ID NO: 3009 - DNA, 21 bp, synthetic construct
  misc_feature 1..21: note = n-mer motif encoding polynucleotide
  source 1..21: mol_type = other DNA
atctcagaaatgactaggtac

SEQ ID NO: 3010 - DNA, 21 bp, synthetic construct
  misc_feature 1..21: note = n-mer motif encoding polynucleotide
  source 1..21: mol_type = other DNA
attgctactaatgtgatttat

SEQ ID NO: 3011 - DNA, 21 bp, synthetic construct
  misc_feature 1..21: note = n-mer motif encoding polynucleotide
  source 1..21: mol_type = other DNA
aacggcaaccactccatagac

SEQ ID NO: 3012 - DNA, 21 bp, synthetic construct
  misc_feature 1..21: note = n-mer motif encoding polynucleotide
  source 1..21: mol_type = other DNA
acgagtattggtagtgctaag

SEQ ID NO: 3013 - DNA, 21 bp, synthetic construct
  misc_feature 1..21: note = n-mer motif encoding polynucleotide
  source 1..21: mol_type = other DNA
aacgtacactctgttgacaaa

SEQ ID NO: 3014 - DNA, 21 bp, synthetic construct
  misc_feature 1..21: note = n-mer motif encoding polynucleotide
  source 1..21: mol_type = other DNA
gaactctccgttccgaaacca

SEQ ID NO: 3015 - DNA, 21 bp, synthetic construct
  misc_feature 1..21: note = n-mer motif encoding polynucleotide
  source 1..21: mol_type = other DNA
ttcctcgacaaatacaactac

SEQ ID NO: 3016 - DNA, 21 bp, synthetic construct
  misc_feature 1..21: note = n-mer motif encoding polynucleotide
  source 1..21: mol_type = other DNA
tacatcccgaacaactcagga

SEQ ID NO: 3017 - DNA, 21 bp, synthetic construct
  misc_feature 1..21: note = n-mer motif encoding polynucleotide
  source 1..21: mol_type = other DNA
gggctaggacaaccccaactc

SEQ ID NO: 3018 - DNA, 21 bp, synthetic construct
  misc_feature 1..21: note = n-mer motif encoding polynucleotide
  source 1..21: mol_type = other DNA
gaggggagtcaggggaatcat

SEQ ID NO: 3019 - DNA, 21 bp, synthetic construct
  misc_feature 1..21: note = n-mer motif encoding polynucleotide
  source 1..21: mol_type = other DNA
aatatttatatggcgagtggt

SEQ ID NO: 3020 - DNA, 21 bp, synthetic construct
  misc_feature 1..21: note = n-mer motif encoding polynucleotide
  source 1..21: mol_type = other DNA
aatttgcagactggtgttcag

SEQ ID NO: 3021 - DNA, 21 bp, synthetic construct
  misc_feature 1..21: note = n-mer motif encoding polynucleotide
  source 1..21: mol_type = other DNA
accgtcgctccctacagtagc

SEQ ID NO: 3022 - DNA, 21 bp, synthetic construct
  misc_feature 1..21: note = n-mer motif encoding polynucleotide
  source 1..21: mol_type = other DNA
tcaaactactctgacggaata

SEQ ID NO: 3023 - DNA, 21 bp, synthetic construct
  misc_feature 1..21: note = n-mer motif encoding polynucleotide
  source 1..21: mol_type = other DNA
gctacttacgttgtcggaaca

SEQ ID NO: 3024 - DNA, 21 bp, synthetic construct
  misc_feature 1..21: note = n-mer motif encoding polynucleotide
  source 1..21: mol_type = other DNA
tcaagggaagcgggttcaact

SEQ ID NO: 3025 - DNA, 21 bp, synthetic construct
  misc_feature 1..21: note = n-mer motif encoding polynucleotide
  source 1..21: mol_type = other DNA
gccggaaaaacccacgccgac

SEQ ID NO: 3026 - DNA, 21 bp, synthetic construct
  misc_feature 1..21: note = n-mer motif encoding polynucleotide
  source 1..21: mol_type = other DNA
ccgctttctcttcataatagt

SEQ ID NO: 3027 - DNA, 21 bp, synthetic construct
  misc_feature 1..21: note = n-mer motif encoding polynucleotide
  source 1..21: mol_type = other DNA
cttcgagacctaaacggagga

SEQ ID NO: 3028 - DNA, 21 bp, synthetic construct
  misc_feature 1..21: note = n-mer motif encoding polynucleotide
  source 1..21: mol_type = other DNA
gataggacgtattcgaatacg

SEQ ID NO: 3029 - DNA, 21 bp, synthetic construct
  misc_feature 1..21: note = n-mer motif encoding polynucleotide
  source 1..21: mol_type = other DNA
tcggtcaccagtggaacacaa

SEQ ID NO: 3030 - DNA, 21 bp, synthetic construct
  misc_feature 1..21: note = n-mer motif encoding polynucleotide
  source 1..21: mol_type = other DNA
aatatgacttcggcttatcat

SEQ ID NO: 3031 - DNA, 21 bp, synthetic construct
  misc_feature 1..21: note = n-mer motif encoding polynucleotide
  source 1..21: mol_type = other DNA
gttatgggtggtcctgggatt

SEQ ID NO: 3032 - DNA, 21 bp, synthetic construct
  misc_feature 1..21: note = n-mer motif encoding polynucleotide
  source 1..21: mol_type = other DNA
gctgggactcatactgataag

SEQ ID NO: 3033 - DNA, 21 bp, synthetic construct
  misc_feature 1..21: note = n-mer motif encoding polynucleotide
  source 1..21: mol_type = other DNA
ggtactatgaatattggtatt

SEQ ID NO: 3034 - DNA, 21 bp, synthetic construct
  misc_feature 1..21: note = n-mer motif encoding polynucleotide
  source 1..21: mol_type = other DNA
acagccggcggcgaacgcgcc

SEQ ID NO: 3035 - DNA, 21 bp, synthetic construct
  misc_feature 1..21: note = n-mer motif encoding polynucleotide
  source 1..21: mol_type = other DNA
ggtatgacttctaatcaggtt

SEQ ID NO: 3036 - DNA, 21 bp, synthetic construct
  misc_feature 1..21: note = n-mer motif encoding polynucleotide
  source 1..21: mol_type = other DNA
catttttcgcagattactaat

SEQ ID NO: 3037 - DNA, 21 bp, synthetic construct
  misc_feature 1..21: note = n-mer motif encoding polynucleotide
  source 1..21: mol_type = other DNA
agcaggatagaaaacaacaac

SEQ ID NO: 3038 - DNA, 21 bp, synthetic construct
  misc_feature 1..21: note = n-mer motif encoding polynucleotide
  source 1..21: mol_type = other DNA
gatacggcgagttataataat

SEQ ID NO: 3039 - DNA, 21 bp, synthetic construct
  misc_feature 1..21: note = n-mer motif encoding polynucleotide
  source 1..21: mol_type = other DNA
gtgaatcagagtcctggggct

SEQ ID NO: 3040 - DNA, 21 bp, synthetic construct
  misc_feature 1..21: note = n-mer motif encoding polynucleotide
  source 1..21: mol_type = other DNA
aataatatgggtcatggtcat

SEQ ID NO: 3041 - DNA, 21 bp, synthetic construct
  misc_feature 1..21: note = n-mer motif encoding polynucleotide
  source 1..21: mol_type = other DNA
tcgcggctatcacaagacccc

SEQ ID NO: 3042 - DNA, 21 bp, synthetic construct
  misc_feature 1..21: note = n-mer motif encoding polynucleotide
  source 1..21: mol_type = other DNA
tctacgtctcaggctgtgcag

SEQ ID NO: 3043 - DNA, 21 bp, synthetic construct
  misc_feature 1..21: note = n-mer motif encoding polynucleotide
  source 1..21: mol_type = other DNA
cgatggcaaggactgagcgcg

SEQ ID NO: 3044 - DNA, 21 bp, synthetic construct
  misc_feature 1..21: note = n-mer motif encoding polynucleotide
  source 1..21: mol_type = other DNA
gcgcatatgcattcggagttg

SEQ ID NO: 3045 - DNA, 21 bp, synthetic construct
  misc_feature 1..21: note = n-mer motif encoding polynucleotide
  source 1..21: mol_type = other DNA
aataatcttacgaattcgacg

SEQ ID NO: 3046 - DNA, 21 bp, synthetic construct
  misc_feature 1..21: note = n-mer motif encoding polynucleotide
  source 1..21: mol_type = other DNA
cagcctagtgcgagtgagctt

SEQ ID NO: 3047 - DNA, 21 bp, synthetic construct
  misc_feature 1..21: note = n-mer motif encoding polynucleotide
  source 1..21: mol_type = other DNA
gggacttccttggaaaaccga

SEQ ID NO: 3048 - DNA, 21 bp, synthetic construct
  misc_feature 1..21: note = n-mer motif encoding polynucleotide
  source 1..21: mol_type = other DNA
ctgtctaattcgattacgcct

SEQ ID NO: 3049 - DNA, 21 bp, synthetic construct
  misc_feature 1..21: note = n-mer motif encoding polynucleotide
  source 1..21: mol_type = other DNA
accatagtgtccacttcttac

SEQ ID NO: 3050 - DNA, 21 bp, synthetic construct
  misc_feature 1..21: note = n-mer motif encoding polynucleotide
  source 1..21: mol_type = other DNA
accctaggctacccagacaaa

SEQ ID NO: 3051 - DNA, 21 bp, synthetic construct
  misc_feature 1..21: note = n-mer motif encoding polynucleotide
  source 1..21: mol_type = other DNA
tcaagacacgacgtccgaaac

SEQ ID NO: 3052 - DNA, 21 bp, synthetic construct
  misc_feature 1..21: note = n-mer motif encoding polynucleotide
  source 1..21: mol_type = other DNA
aatggtagtgtggctaatcct

SEQ ID NO: 3053 - DNA, 21 bp, synthetic construct
  misc_feature 1..21: note = n-mer motif encoding polynucleotide
  source 1..21: mol_type = other DNA
gcgatggatgggtatagggtt

SEQ ID NO: 3054 - DNA, 21 bp, synthetic construct
  misc_feature 1..21: note = n-mer motif encoding polynucleotide
  source 1..21: mol_type = other DNA
tggacgggcgcacaaccttct

SEQ ID NO: 3055 - DNA, 21 bp, synthetic construct
  misc_feature 1..21: note = n-mer motif encoding polynucleotide
  source 1..21: mol_type = other DNA
aaaaacggcgccataggaaca

SEQ ID NO: 3056 - DNA, 21 bp, synthetic construct
  misc_feature 1..21: note = n-mer motif encoding polynucleotide
  source 1..21: mol_type = other DNA
gtacttccaagtcggatcgcg

SEQ ID NO: 3057 - DNA, 21 bp, synthetic construct
  misc_feature 1..21: note = n-mer motif encoding polynucleotide
  source 1..21: mol_type = other DNA
gataatgtgaattctcagcct

SEQ ID NO: 3058 - DNA, 21 bp, synthetic construct
  misc_feature 1..21: note = n-mer motif encoding polynucleotide
  source 1..21: mol_type = other DNA
ggcgtaaacgctagctacagc

SEQ ID NO: 3059 - DNA, 21 bp, synthetic construct
  misc_feature 1..21: note = n-mer motif encoding polynucleotide
  source 1..21: mol_type = other DNA
ctgtctcacgccatggaccgg

SEQ ID NO: 3060 - DNA, 21 bp, synthetic construct
  misc_feature 1..21: note = n-mer motif encoding polynucleotide
  source 1..21: mol_type = other DNA
agggctcatggggataatcag

SEQ ID NO: 3061 - DNA, 21 bp, synthetic construct
  misc_feature 1..21: note = n-mer motif encoding polynucleotide
  source 1..21: mol_type = other DNA
ttgcagacgcctgggacgacg

SEQ ID NO: 3062 - DNA, 21 bp, synthetic construct
  misc_feature 1..21: note = n-mer motif encoding polynucleotide
  source 1..21: mol_type = other DNA
actcaggttgttagtatttat

SEQ ID NO: 3063 - DNA, 21 bp, synthetic construct
  misc_feature 1..21: note = n-mer motif encoding polynucleotide
  source 1..21: mol_type = other DNA
caggttcaggggactctgggg

SEQ ID NO: 3064 - DNA, 21 bp, synthetic construct
  misc_feature 1..21: note = n-mer motif encoding polynucleotide
  source 1..21: mol_type = other DNA
gtgggcaaccaaaacttaccc

SEQ ID NO: 3065 - DNA, 21 bp, synthetic construct
  misc_feature 1..21: note = n-mer motif encoding polynucleotide
  source 1..21: mol_type = other DNA
tatgttgattatagtaagtcg

SEQ ID NO: 3066 - DNA, 21 bp, synthetic construct
  misc_feature 1..21: note = n-mer motif encoding polynucleotide
  source 1..21: mol_type = other DNA
ctgcttaattcttcgggtgtg

SEQ ID NO: 3067 - DNA, 21 bp, synthetic construct
  misc_feature 1..21: note = n-mer motif encoding polynucleotide
  source 1..21: mol_type = other DNA
aatcagtcgcttactatggat

SEQ ID NO: 3068 - DNA, 21 bp, synthetic construct
  misc_feature 1..21: note = n-mer motif encoding polynucleotide
  source 1..21: mol_type = other DNA
gctggtaaggatcttagtaat

SEQ ID NO: 3069 - DNA, 21 bp, synthetic construct
  misc_feature 1..21: note = n-mer motif encoding polynucleotide
  source 1..21: mol_type = other DNA
tcttacgttagcgtccccgcc

SEQ ID NO: 3070 - DNA, 21 bp, synthetic construct
  misc_feature 1..21: note = n-mer motif encoding polynucleotide
  source 1..21: mol_type = other DNA
aatgaggggcgtgtgcagact

SEQ ID NO: 3071 - DNA, 21 bp, synthetic construct
  misc_feature 1..21: note = n-mer motif encoding polynucleotide
  source 1..21: mol_type = other DNA
actttgacgcagactgggatg

SEQ ID NO: 3072 - DNA, 21 bp, synthetic construct
  misc_feature 1..21: note = n-mer motif encoding polynucleotide
  source 1..21: mol_type = other DNA
ggcttcgcattaactggcacc

SEQ ID NO: 3073 - DNA, 21 bp, synthetic construct
  misc_feature 1..21: note = n-mer motif encoding polynucleotide
  source 1..21: mol_type = other DNA
cagtcgacgctgaataggcct

SEQ ID NO: 3074 - DNA, 21 bp, synthetic construct
  misc_feature 1..21: note = n-mer motif encoding polynucleotide
  source 1..21: mol_type = other DNA
acaacaacacactccatctcc

SEQ ID NO: 3075 - DNA, 21 bp, synthetic construct
  misc_feature 1..21: note = n-mer motif encoding polynucleotide
  source 1..21: mol_type = other DNA
aacacacacagacaagaatac

SEQ ID NO: 3076 - DNA, 21 bp, synthetic construct
  misc_feature 1..21: note = n-mer motif encoding polynucleotide
  source 1..21: mol_type = other DNA
tcccaaatagtcaacaccaca

SEQ ID NO: 3077 - DNA, 21 bp, synthetic construct
  misc_feature 1..21: note = n-mer motif encoding polynucleotide
  source 1..21: mol_type = other DNA
ctggtgcttgagatgcagacg

SEQ ID NO: 3078 - DNA, 21 bp, synthetic construct
  misc_feature 1..21: note = n-mer motif encoding polynucleotide
  source 1..21: mol_type = other DNA
aacgacatctccacccaacgg

SEQ ID NO: 3079 - DNA, 21 bp, synthetic construct
  misc_feature 1..21: note = n-mer motif encoding polynucleotide
  source 1..21: mol_type = other DNA
tacaccgccgacaaaaaacaa

SEQ ID NO: 3080 - DNA, 21 bp, synthetic construct
  misc_feature 1..21: note = n-mer motif encoding polynucleotide
  source 1..21: mol_type = other DNA
ttcggagcaaccaccacagca

SEQ ID NO: 3081 - DNA, 21 bp, synthetic construct
  misc_feature 1..21: note = n-mer motif encoding polynucleotide
  source 1..21: mol_type = other DNA
gttcagatttctatgaataat

SEQ ID NO: 3082 - DNA, 21 bp, synthetic construct
  misc_feature 1..21: note = n-mer motif encoding polynucleotide
  source 1..21: mol_type = other DNA
atgcatgcgcaggagtctcgt

SEQ ID NO: 3083 - DNA, 21 bp, synthetic construct
  misc_feature 1..21: note = n-mer motif encoding polynucleotide
  source 1..21: mol_type = other DNA
catgtgaatactgctgatcgg

SEQ ID NO: 3084 - DNA, 21 bp, synthetic construct
  misc_feature 1..21: note = n-mer motif encoding polynucleotide
  source 1..21: mol_type = other DNA
tacagtacagactccaccaaa

SEQ ID NO: 3085 - DNA, 21 bp, synthetic construct
  misc_feature 1..21: note = n-mer motif encoding polynucleotide
  source 1..21: mol_type = other DNA
ggacacgaccgaacaccaaac

SEQ ID NO: 3086 - DNA, 21 bp, synthetic construct
  misc_feature 1..21: note = n-mer motif encoding polynucleotide
  source 1..21: mol_type = other DNA
acgagtggtgtgcttacgcgg

SEQ ID NO: 3087 - DNA, 21 bp, synthetic construct
  misc_feature 1..21: note = n-mer motif encoding polynucleotide
  source 1..21: mol_type = other DNA
aatattgctatgtctaagatt

SEQ ID NO: 3088 - DNA, 21 bp, synthetic construct
  misc_feature 1..21: note = n-mer motif encoding polynucleotide
  source 1..21: mol_type = other DNA
atggggactgagtatcgtatg

SEQ ID NO: 3089 - DNA, 21 bp, synthetic construct
  misc_feature 1..21: note = n-mer motif encoding polynucleotide
  source 1..21: mol_type = other DNA
ccttatgcgaataggcttgag

SEQ ID NO: 3090 - DNA, 21 bp, synthetic construct
  misc_feature 1..21: note = n-mer motif encoding polynucleotide
  source 1..21: mol_type = other DNA
ccgcttcagaataataagacg

SEQ ID NO: 3091 - DNA, 21 bp, synthetic construct
  misc_feature 1..21: note = n-mer motif encoding polynucleotide
  source 1..21: mol_type = other DNA
tccttgacggaaaaagcgccg

SEQ ID NO: 3092 - DNA, 21 bp, synthetic construct
  misc_feature 1..21: note = n-mer motif encoding polynucleotide
  source 1..21: mol_type = other DNA
aatatggtgtatacgaatgtg

SEQ ID NO: 3093 - DNA, 21 bp, synthetic construct
  misc_feature 1..21: note = n-mer motif encoding polynucleotide
  source 1..21: mol_type = other DNA
atgttaagtgccacccaaggg

SEQ ID NO: 3094 - DNA, 21 bp, synthetic construct
  misc_feature 1..21: note = n-mer motif encoding polynucleotide
  source 1..21: mol_type = other DNA
aacatgactcactcaaccgta

SEQ ID NO: 3095 - DNA, 21 bp, synthetic construct
  misc_feature 1..21: note = n-mer motif encoding polynucleotide
  source 1..21: mol_type = other DNA
atttatacgaatagtcatgtt

SEQ ID NO: 3096 - DNA, 21 bp, synthetic construct
  misc_feature 1..21: note = n-mer motif encoding polynucleotide
  source 1..21: mol_type = other DNA
tggtcgcatgatcggcctact

SEQ ID NO: 3097 - DNA, 21 bp, synthetic construct
  misc_feature 1..21: note = n-mer motif encoding polynucleotide
  source 1..21: mol_type = other DNA
gaaaaaggcacaccaagtagc

SEQ ID NO: 3098 - DNA, 21 bp, synthetic construct
  misc_feature 1..21: note = n-mer motif encoding polynucleotide
  source 1..21: mol_type = other DNA
catcattctactgagtcgttg

SEQ ID NO: 3099 - DNA, 21 bp, synthetic construct
  misc_feature 1..21: note = n-mer motif encoding polynucleotide
  source 1..21: mol_type = other DNA
ccaaaaagcacccaagtaatg

SEQ ID NO: 3100 - DNA, 21 bp, synthetic construct
  misc_feature 1..21: note = n-mer motif encoding polynucleotide
  source 1..21: mol_type = other DNA
agtgataggactgctcagcag

SEQ ID NO: 3101 - DNA, 21 bp, synthetic construct
  misc_feature 1..21: note = n-mer motif encoding polynucleotide
  source 1..21: mol_type = other DNA
gctaccctcgcacggacctca

SEQ ID NO: 3102 - DNA, 21 bp, synthetic construct
  misc_feature 1..21: note = n-mer motif encoding polynucleotide
  source 1..21: mol_type = other DNA
atttctcaggtgtcttttaat

SEQ ID NO: 3103 - DNA, 21 bp, synthetic construct
  misc_feature 1..21: note = n-mer motif encoding polynucleotide
  source 1..21: mol_type = other DNA
cattatgggaataaggatatt

SEQ ID NO: 3104 - DNA, 21 bp, synthetic construct
  misc_feature 1..21: note = n-mer motif encoding polynucleotide
  source 1..21: mol_type = other DNA
aatgatgggactgatcgtagg

SEQ ID NO: 3105 - DNA, 21 bp, synthetic construct
  misc_feature 1..21: note = n-mer motif encoding polynucleotide
  source 1..21: mol_type = other DNA
accaaccacataaccggtcca

SEQ ID NO: 3106 - DNA, 21 bp, synthetic construct
  misc_feature 1..21: note = n-mer motif encoding polynucleotide
  source 1..21: mol_type = other DNA
actaattctaatcagagttcg

SEQ ID NO: 3107 - DNA, 21 bp, synthetic construct
  misc_feature 1..21: note = n-mer motif encoding polynucleotide
  source 1..21: mol_type = other DNA
gtggcgactcattataatgag

SEQ ID NO: 3108 - DNA, 21 bp, synthetic construct
  misc_feature 1..21: note = n-mer motif encoding polynucleotide
  source 1..21: mol_type = other DNA
gacctcggtacggctagaacc

SEQ ID NO: 3109 - DNA, 21 bp, synthetic construct
  misc_feature 1..21: note = n-mer motif encoding polynucleotide
  source 1..21: mol_type = other DNA
gctcttagtcagagtgcgggt

SEQ ID NO: 3110 - DNA, 21 bp, synthetic construct
  misc_feature 1..21: note = n-mer motif encoding polynucleotide
  source 1..21: mol_type = other DNA
aaaaccaccctacaccaagca

SEQ ID NO: 3111 - DNA, 21 bp, synthetic construct
  misc_feature 1..21: note = n-mer motif encoding polynucleotide
  source 1..21: mol_type = other DNA
atgataaacgccataactcca

SEQ ID NO: 3112 - DNA, 21 bp, synthetic construct
  misc_feature 1..21: note = n-mer motif encoding polynucleotide
  source 1..21: mol_type = other DNA
gggtctacgccgggggcgagt

SEQ ID NO: 3113 - DNA, 21 bp, synthetic construct
  misc_feature 1..21: note = n-mer motif encoding polynucleotide
  source 1..21: mol_type = other DNA
aatgagaagccgcagtcgacg

SEQ ID NO: 3114 - DNA, 21 bp, synthetic construct
  misc_feature 1..21: note = n-mer motif encoding polynucleotide
  source 1..21: mol_type = other DNA
tcattgatgggcagtgcagga

SEQ ID NO: 3115 - DNA, 21 bp, synthetic construct
  misc_feature 1..21: note = n-mer motif encoding polynucleotide
  source 1..21: mol_type = other DNA
accgacacgctcagcgaaaga

SEQ ID NO: 3116 - DNA, 21 bp, synthetic construct
  misc_feature 1..21: note = n-mer motif encoding polynucleotide
  source 1..21: mol_type = other DNA
gcctcgcaatcagaaaaaaac

SEQ ID NO: 3117 - DNA, 21 bp, synthetic construct
  misc_feature 1..21: note = n-mer motif encoding polynucleotide
  source 1..21: mol_type = other DNA
gctgttagaacaccggcaatg

SEQ ID NO: 3118 - DNA, 21 bp, synthetic construct
  misc_feature 1..21: note = n-mer motif encoding polynucleotide
  source 1..21: mol_type = other DNA
cctaatgctagttttggtccg

SEQ ID NO: 3119 - DNA, 21 bp, synthetic construct
  misc_feature 1..21: note = n-mer motif encoding polynucleotide
  source 1..21: mol_type = other DNA
aaagcccacgttgtagaaata

SEQ ID NO: 3120 - DNA, 21 bp, synthetic construct
  misc_feature 1..21: note = n-mer motif encoding polynucleotide
  source 1..21: mol_type = other DNA
tatatttcggcgcctccgatg

SEQ ID NO: 3121 - DNA, 21 bp, synthetic construct
  misc_feature 1..21: note = n-mer motif encoding polynucleotide
  source 1..21: mol_type = other DNA
ccaatccaaaacgaatcgtcc

SEQ ID NO: 3122 - DNA, 21 bp, synthetic construct
  misc_feature 1..21: note = n-mer motif encoding polynucleotide
  source 1..21: mol_type = other DNA
ggcgtaaccaacgcttccaaa

SEQ ID NO: 3123 - DNA, 21 bp, synthetic construct
  misc_feature 1..21: note = n-mer motif encoding polynucleotide
  source 1..21: mol_type = other DNA
gtaaacgggggaaaaccagtc

SEQ ID NO: 3124 - DNA, 21 bp, synthetic construct
  misc_feature 1..21: note = n-mer motif encoding polynucleotide
  source 1..21: mol_type = other DNA
agtgttctgagtagttcgact

SEQ ID NO: 3125 - DNA, 21 bp, synthetic construct
  misc_feature 1..21: note = n-mer motif encoding polynucleotide
  source 1..21: mol_type = other DNA
ttagcacaaggcacggaccgg

SEQ ID NO: 3126 - DNA, 21 bp, synthetic construct
  misc_feature 1..21: note = n-mer motif encoding polynucleotide
  source 1..21: mol_type = other DNA
cagtctgtgtcgactggggcg

SEQ ID NO: 3127 - DNA, 21 bp, synthetic construct
  misc_feature 1..21: note = n-mer motif encoding polynucleotide
  source 1..21: mol_type = other DNA
ttgacgcaggtttatcatgag

SEQ ID NO: 3128 - DNA, 21 bp, synthetic construct
  misc_feature 1..21: note = n-mer motif encoding polynucleotide
  source 1..21: mol_type = other DNA
agagaaatgagcagcctatct

SEQ ID NO: 3129 - DNA, 21 bp, synthetic construct
  misc_feature 1..21: note = n-mer motif encoding polynucleotide
  source 1..21: mol_type = other DNA
acgagtacgatgactgcgcgt

SEQ ID NO: 3130 - DNA, 21 bp, synthetic construct
  misc_feature 1..21: note = n-mer motif encoding polynucleotide
  source 1..21: mol_type = other DNA
actattcagcaggttagtaat

SEQ ID NO: 3131 - DNA, 21 bp, synthetic construct
  misc_feature 1..21: note = n-mer motif encoding polynucleotide
  source 1..21: mol_type = other DNA
aggacgcaagcaggggactca

SEQ ID NO: 3132 - DNA, 21 bp, synthetic construct
  misc_feature 1..21: note = n-mer motif encoding polynucleotide
  source 1..21: mol_type = other DNA
aatacttatactgctgggaag

SEQ ID NO: 3133 - DNA, 21 bp, synthetic construct
  misc_feature 1..21: note = n-mer motif encoding polynucleotide
  source 1..21: mol_type = other DNA
aatgagcagaatacgccgagt

SEQ ID NO: 3134 - DNA, 21 bp, synthetic construct
  misc_feature 1..21: note = n-mer motif encoding polynucleotide
  source 1..21: mol_type = other DNA
ggattcgcccaacaagaagcg

SEQ ID NO: 3135 - DNA, 21 bp, synthetic construct
  misc_feature 1..21: note = n-mer motif encoding polynucleotide
  source 1..21: mol_type = other DNA
agtccgcagcatggtgttatt

SEQ ID NO: 3136 - DNA, 21 bp, synthetic construct
  misc_feature 1..21: note = n-mer motif encoding polynucleotide
  source 1..21: mol_type = other DNA
gcagtccacgcaacatcatca

SEQ ID NO: 3137 - DNA, 21 bp, synthetic construct
  misc_feature 1..21: note = n-mer motif encoding polynucleotide
  source 1..21: mol_type = other DNA
ggagacacccgtggtgcacac

SEQ ID NO: 3138 - DNA, 21 bp, synthetic construct
  misc_feature 1..21: note = n-mer motif encoding polynucleotide
  source 1..21: mol_type = other DNA
gtaagagaaaccacacacctc

SEQ ID NO: 3139 - DNA, 21 bp, synthetic construct
  misc_feature 1..21: note = n-mer motif encoding polynucleotide
  source 1..21: mol_type = other DNA
ctttctcaacaacgcgactac

SEQ ID NO: 3140 - DNA, 21 bp, synthetic construct
  misc_feature 1..21: note = n-mer motif encoding polynucleotide
  source 1..21: mol_type = other DNA
gcgactaggggtgagtcgtct

SEQ ID NO: 3141 - DNA, 21 bp, synthetic construct
  misc_feature 1..21: note = n-mer motif encoding polynucleotide
  source 1..21: mol_type = other DNA
actaatgattctgtgggtagt

SEQ ID NO: 3142 - DNA, 21 bp, synthetic construct
  misc_feature 1..21: note = n-mer motif encoding polynucleotide
  source 1..21: mol_type = other DNA
cttactaataattttaaggat

SEQ ID NO: 3143 - DNA, 21 bp, synthetic construct
  misc_feature 1..21: note = n-mer motif encoding polynucleotide
  source 1..21: mol_type = other DNA
gtgaatgggactcagattttt

SEQ ID NO: 3144 - DNA, 21 bp, synthetic construct
  misc_feature 1..21: note = n-mer motif encoding polynucleotide
  source 1..21: mol_type = other DNA
ggtaatactgggagtccgggg

SEQ ID NO: 3145 - DNA, 21 bp, synthetic construct
  misc_feature 1..21: note = n-mer motif encoding polynucleotide
  source 1..21: mol_type = other DNA
tggacagctaaccaaggctta

SEQ ID NO: 3146 - DNA, 21 bp, synthetic construct
  misc_feature 1..21: note = n-mer motif encoding polynucleotide
  source 1..21: mol_type = other DNA
aatactactccgacgaatcat

SEQ ID NO: 3147 - DNA, 21 bp, synthetic construct
  misc_feature 1..21: note = n-mer motif encoding polynucleotide
  source 1..21: mol_type = other DNA
gaacgagtcaacgggatggca

SEQ ID NO: 3148 - DNA, 21 bp, synthetic construct
  misc_feature 1..21: note = n-mer motif encoding polynucleotide
  source 1..21: mol_type = other DNA
aaagtcacaaacaacgcatac

SEQ ID NO: 3149 - DNA, 21 bp, synthetic construct
  misc_feature 1..21: note = n-mer motif encoding polynucleotide
  source 1..21: mol_type = other DNA
ttatcctccgaatcacccagg

SEQ ID NO: 3150 - DNA, 21 bp, synthetic construct
  misc_feature 1..21: note = n-mer motif encoding polynucleotide
  source 1..21: mol_type = other DNA
catacggcggcggttgctact

SEQ ID NO: 3151 - DNA, 21 bp, synthetic construct
  misc_feature 1..21: note = n-mer motif encoding polynucleotide
  source 1..21: mol_type = other DNA
tacgacagccgactctacgcg

SEQ ID NO: 3152 - DNA, 21 bp, synthetic construct
  misc_feature 1..21: note = n-mer motif encoding polynucleotide
  source 1..21: mol_type = other DNA
atagaacacatgcttagaccc

SEQ ID NO: 3153 - DNA, 21 bp, synthetic construct
  misc_feature 1..21: note = n-mer motif encoding polynucleotide
  source 1..21: mol_type = other DNA
tacctagaatccaactacacc

SEQ ID NO: 3154 - DNA, 21 bp, synthetic construct
  misc_feature 1..21: note = n-mer motif encoding polynucleotide
  source 1..21: mol_type = other DNA
gcgtactcatctaccgggcac

SEQ ID NO: 3155 - DNA, 21 bp, synthetic construct
  misc_feature 1..21: note = n-mer motif encoding polynucleotide
  source 1..21: mol_type = other DNA
atcgacatatcgacgcaaagc

SEQ ID NO: 3156 - DNA, 21 bp, synthetic construct
  misc_feature 1..21: note = n-mer motif encoding polynucleotide
  source 1..21: mol_type = other DNA
acaacaaactcaggcgcgacg

SEQ ID NO: 3157 - DNA, 21 bp, synthetic construct
  misc_feature 1..21: note = n-mer motif encoding polynucleotide
  source 1..21: mol_type = other DNA
aacgtgctaaccacggttgtc

SEQ ID NO: 3158 - DNA, 21 bp, synthetic construct
  misc_feature 1..21: note = n-mer motif encoding polynucleotide
  source 1..21: mol_type = other DNA
acaaccggaatcgaacgttcc

SEQ ID NO: 3159 - DNA, 21 bp, synthetic construct
  misc_feature 1..21: note = n-mer motif encoding polynucleotide
  source 1..21: mol_type = other DNA
gcacgagtggacaccaaccaa

SEQ ID NO: 3160 - DNA, 21 bp, synthetic construct
  misc_feature 1..21: note = n-mer motif encoding polynucleotide
  source 1..21: mol_type = other DNA
cagagtgtgaaggaggcgatt

SEQ ID NO: 3161 - DNA, 21 bp, synthetic construct
  misc_feature 1..21: note = n-mer motif encoding polynucleotide
  source 1..21: mol_type = other DNA
gcgttgcttagtgtgaatgag

SEQ ID NO: 3162 - DNA, 21 bp, synthetic construct
  misc_feature 1..21: note = n-mer motif encoding polynucleotide
  source 1..21: mol_type = other DNA
gggcgtgataatcatcatgcg

SEQ ID NO: 3163 - DNA, 21 bp, synthetic construct
  misc_feature 1..21: note = n-mer motif encoding polynucleotide
  source 1..21: mol_type = other DNA
attcagtcgcagtcgcagttg

SEQ ID NO: 3164 - DNA, 21 bp, synthetic construct
  misc_feature 1..21: note = n-mer motif encoding polynucleotide
  source 1..21: mol_type = other DNA
agtgagggtagttcgcggtcg

SEQ ID NO: 3165 - DNA, 21 bp, synthetic construct
  misc_feature 1..21: note = n-mer motif encoding polynucleotide
  source 1..21: mol_type = other DNA
gacgtccaaaacatacgcgaa

SEQ ID NO: 3166 - DNA, 21 bp, synthetic construct
  misc_feature 1..21: note = n-mer motif encoding polynucleotide
  source 1..21: mol_type = other DNA
aaaggccacgcctacgaagcc

SEQ ID NO: 3167 - DNA, 21 bp, synthetic construct
  misc_feature 1..21: note = n-mer motif encoding polynucleotide
  source 1..21: mol_type = other DNA
tatgttagggcgcaggatcag

SEQ ID NO: 3168 - DNA, 21 bp, synthetic construct
  misc_feature 1..21: note = n-mer motif encoding polynucleotide
  source 1..21: mol_type = other DNA
gtcgacgaataccgaagccgc

SEQ ID NO: 3169 - DNA, 21 bp, synthetic construct
  misc_feature 1..21: note = n-mer motif encoding polynucleotide
  source 1..21: mol_type = other DNA
actctctcaggctacatgaga

SEQ ID NO: 3170 - DNA, 21 bp, synthetic construct
  misc_feature 1..21: note = n-mer motif encoding polynucleotide
  source 1..21: mol_type = other DNA
cctagtgtccgtttgccctta

SEQ ID NO: 3171 - DNA, 21 bp, synthetic construct
  misc_feature 1..21: note = n-mer motif encoding polynucleotide
  source 1..21: mol_type = other DNA
aacatagcaggcggagaacaa

SEQ ID NO: 3172 - DNA, 21 bp, synthetic construct
  misc_feature 1..21: note = n-mer motif encoding polynucleotide
  source 1..21: mol_type = other DNA
ctgctccaatcgacctacttg

SEQ ID NO: 3173 - DNA, 21 bp, synthetic construct
  misc_feature 1..21: note = n-mer motif encoding polynucleotide
  source 1..21: mol_type = other DNA
cagtcggatacgacttcgatt

SEQ ID NO: 3174 - DNA, 21 bp, synthetic construct
  misc_feature 1..21: note = n-mer motif encoding polynucleotide
  source 1..21: mol_type = other DNA
attaggtctgggaatgcgatg

SEQ ID NO: 3175 - DNA, 21 bp, synthetic construct
  misc_feature 1..21: note = n-mer motif encoding polynucleotide
  source 1..21: mol_type = other DNA
atgctgtctcaagtcttaaca

SEQ ID NO: 3176 - DNA, 21 bp, synthetic construct
  misc_feature 1..21: note = n-mer motif encoding polynucleotide
  source 1..21: mol_type = other DNA
acagaacgccaaatcgaatta

SEQ ID NO: 3177 - DNA, 21 bp, synthetic construct
  misc_feature 1..21: note = n-mer motif encoding polynucleotide
  source 1..21: mol_type = other DNA
ggaacccacgcctcagcatac

SEQ ID NO: 3178 - DNA, 21 bp, synthetic construct
  misc_feature 1..21: note = n-mer motif encoding polynucleotide
  source 1..21: mol_type = other DNA
gttgagtcttcttattctcgg

SEQ ID NO: 3179 - DNA, 21 bp, synthetic construct
  misc_feature 1..21: note = n-mer motif encoding polynucleotide
  source 1..21: mol_type = other DNA
ggtgggaattatcatactaag

SEQ ID NO: 3180 - DNA, 21 bp, synthetic construct
  misc_feature 1..21: note = n-mer motif encoding polynucleotide
  source 1..21: mol_type = other DNA
cccaccagtcaccaagaaccc

SEQ ID NO: 3181 - DNA, 21 bp, synthetic construct
  misc_feature 1..21: note = n-mer motif encoding polynucleotide
  source 1..21: mol_type = other DNA
accataatcggtgtcttaccc

SEQ ID NO: 3182 - DNA, 21 bp, synthetic construct
  misc_feature 1..21: note = n-mer motif encoding polynucleotide
  source 1..21: mol_type = other DNA
tctaacagcggttctaccctc

SEQ ID NO: 3183 - DNA, 21 bp, synthetic construct
  misc_feature 1..21: note = n-mer motif encoding polynucleotide
  source 1..21: mol_type = other DNA
tcgataacgaccgtagcgaac

SEQ ID NO: 3184 - DNA, 21 bp, synthetic construct
  misc_feature 1..21: note = n-mer motif encoding polynucleotide
  source 1..21: mol_type = other DNA
gcgtctccggcgcagaccggc

SEQ ID NO: 3185 - DNA, 21 bp, synthetic construct
  misc_feature 1..21: note = n-mer motif encoding polynucleotide
  source 1..21: mol_type = other DNA
tcgttgccgagtcatagtaat

SEQ ID NO: 3186 - DNA, 21 bp, synthetic construct
  misc_feature 1..21: note = n-mer motif encoding polynucleotide
  source 1..21: mol_type = other DNA
ctacacaacgccgtcggaccc

SEQ ID NO: 3187 - DNA, 21 bp, synthetic construct
  misc_feature 1..21: note = n-mer motif encoding polynucleotide
  source 1..21: mol_type = other DNA
caagccccgccaacagcacaa

SEQ ID NO: 3188 - DNA, 21 bp, synthetic construct
  misc_feature 1..21: note = n-mer motif encoding polynucleotide
  source 1..21: mol_type = other DNA
cctaatactgctagtaatttt

SEQ ID NO: 3189 - DNA, 21 bp, synthetic construct
  misc_feature 1..21: note = n-mer motif encoding polynucleotide
  source 1..21: mol_type = other DNA
ccctccaacagtgaaagattc

SEQ ID NO: 3190 - DNA, 21 bp, synthetic construct
  misc_feature 1..21: note = n-mer motif encoding polynucleotide
  source 1..21: mol_type = other DNA
gaactccacgcacaacaacca

SEQ ID NO: 3191 - DNA, 21 bp, synthetic construct
  misc_feature 1..21: note = n-mer motif encoding polynucleotide
  source 1..21: mol_type = other DNA
ggttcttattctgatggtagt

SEQ ID NO: 3192 - DNA, 21 bp, synthetic construct
  misc_feature 1..21: note = n-mer motif encoding polynucleotide
  source 1..21: mol_type = other DNA
tatggtgtgcaggcgaatagt

SEQ ID NO: 3193 - DNA, 21 bp, synthetic construct
  misc_feature 1..21: note = n-mer motif encoding polynucleotide
  source 1..21: mol_type = other DNA
gaagtaggtaaaaccacccac

SEQ ID NO: 3194 - DNA, 21 bp, synthetic construct
  misc_feature 1..21: note = n-mer motif encoding polynucleotide
  source 1..21: mol_type = other DNA
acttcgcagggtaggagtcct

SEQ ID NO: 3195 - DNA, 21 bp, synthetic construct
  misc_feature 1..21: note = n-mer motif encoding polynucleotide
  source 1..21: mol_type = other DNA
gtagaacacgtagcccaccaa

SEQ ID NO: 3196 - DNA, 21 bp, synthetic construct
  misc_feature 1..21: note = n-mer motif encoding polynucleotide
  source 1..21: mol_type = other DNA
atccaaagcagctacaaccgc

SEQ ID NO: 3197 - DNA, 21 bp, synthetic construct
  misc_feature 1..21: note = n-mer motif encoding polynucleotide
  source 1..21: mol_type = other DNA
acgctatcggttaccctgggt

SEQ ID NO: 3198 - DNA, 21 bp, synthetic construct
  misc_feature 1..21: note = n-mer motif encoding polynucleotide
  source 1..21: mol_type = other DNA
cggaatgagccggttagtact

SEQ ID NO: 3199 - DNA, 21 bp, synthetic construct
  misc_feature 1..21: note = n-mer motif encoding polynucleotide
  source 1..21: mol_type = other DNA
gtgattgtggggagtaatgag

SEQ ID NO: 3200 - DNA, 21 bp, synthetic construct
  misc_feature 1..21: note = n-mer motif encoding polynucleotide
  source 1..21: mol_type = other DNA
gagctgtctactcctatggtt

SEQ ID NO: 3201 - DNA, 21 bp, synthetic construct
  misc_feature 1..21: note = n-mer motif encoding polynucleotide
  source 1..21: mol_type = other DNA
gcttacaacgacctacgatca

SEQ ID NO: 3202 - DNA, 21 bp, synthetic construct
  misc_feature 1..21: note = n-mer motif encoding polynucleotide
  source 1..21: mol_type = other DNA
aacgcgaactccggtgaacga

SEQ ID NO: 3203 - DNA, 21 bp, synthetic construct
  misc_feature 1..21: note = n-mer motif encoding polynucleotide
  source 1..21: mol_type = other DNA
ttgtcatcacaatggacacaa

SEQ ID NO: 3204 - DNA, 21 bp, synthetic construct
  misc_feature 1..21: note = n-mer motif encoding polynucleotide
  source 1..21: mol_type = other DNA
atcaacgccggcaactaccga

SEQ ID NO: 3205 - DNA, 21 bp, synthetic construct
  misc_feature 1..21: note = n-mer motif encoding polynucleotide
  source 1..21: mol_type = other DNA
ctgaggtcgagtgaggctccg

SEQ ID NO: 3206 - DNA, 21 bp, synthetic construct
  misc_feature 1..21: note = n-mer motif encoding polynucleotide
  source 1..21: mol_type = other DNA
acgtctgatacgaatgctagg

SEQ ID NO: 3207 - DNA, 21 bp, synthetic construct
  misc_feature 1..21: note = n-mer motif encoding polynucleotide
  source 1..21: mol_type = other DNA
ccgaattctccgcatggttct

SEQ ID NO: 3208 - DNA, 21 bp, synthetic construct
  misc_feature 1..21: note = n-mer motif encoding polynucleotide
  source 1..21: mol_type = other DNA
acccaacacctaccatccaca

SEQ ID NO: 3209 - DNA, 21 bp, synthetic construct
  misc_feature 1..21: note = n-mer motif encoding polynucleotide
  source 1..21: mol_type = other DNA
gtgcatgggaatgctccggct

SEQ ID NO: 3210 - DNA, 21 bp, synthetic construct
  misc_feature 1..21: note = n-mer motif encoding polynucleotide
  source 1..21: mol_type = other DNA
tcttctcagcgtgattctgtt

SEQ ID NO: 3211 - DNA, 21 bp, synthetic construct
  misc_feature 1..21: note = n-mer motif encoding polynucleotide
  source 1..21: mol_type = other DNA
cccccctcagttgaccgaaaa

SEQ ID NO: 3212 - DNA, 21 bp, synthetic construct
  misc_feature 1..21: note = n-mer motif encoding polynucleotide
  source 1..21: mol_type = other DNA
gagactctgccgtataagagt

SEQ ID NO: 3213 - DNA, 21 bp, synthetic construct
  misc_feature 1..21: note = n-mer motif encoding polynucleotide
  source 1..21: mol_type = other DNA
catcttagtcaggctaatcat

SEQ ID NO: 3214 - DNA, 21 bp, synthetic construct
  misc_feature 1..21: note = n-mer motif encoding polynucleotide
  source 1..21: mol_type = other DNA
aaaccgctaaacggtaccaac

SEQ ID NO: 3215 - DNA, 21 bp, synthetic construct
  misc_feature 1..21: note = n-mer motif encoding polynucleotide
  source 1..21: mol_type = other DNA
tggcaaaccaacggcatgcaa

SEQ ID NO: 3216 - DNA, 21 bp, synthetic construct
  misc_feature 1..21: note = n-mer motif encoding polynucleotide
  source 1..21: mol_type = other DNA
accgtgaacgtccactccgac

SEQ ID NO: 3217 - DNA, 21 bp, synthetic construct
  misc_feature 1..21: note = n-mer motif encoding polynucleotide
  source 1..21: mol_type = other DNA
acccaatacgtcgttgcccct

SEQ ID NO: 3218 - DNA, 21 bp, synthetic construct
  misc_feature 1..21: note = n-mer motif encoding polynucleotide
  source 1..21: mol_type = other DNA
aacgtcgactcctctaacgtg

SEQ ID NO: 3219 - DNA, 21 bp, synthetic construct
  misc_feature 1..21: note = n-mer motif encoding polynucleotide
  source 1..21: mol_type = other DNA
aacggataccaactacaaatc

SEQ ID NO: 3220 - DNA, 21 bp, synthetic construct
  misc_feature 1..21: note = n-mer motif encoding polynucleotide
  source 1..21: mol_type = other DNA
gaagaaacacggaccagaatg

SEQ ID NO: 3221 - DNA, 21 bp, synthetic construct
  misc_feature 1..21: note = n-mer motif encoding polynucleotide
  source 1..21: mol_type = other DNA
acctctccagcctctgaccgg

SEQ ID NO: 3222 - DNA, 21 bp, synthetic construct
  misc_feature 1..21: note = n-mer motif encoding polynucleotide
  source 1..21: mol_type = other DNA
catagtggtgctggggttctg

SEQ ID NO: 3223 - DNA, 21 bp, synthetic construct
  misc_feature 1..21: note = n-mer motif encoding polynucleotide
  source 1..21: mol_type = other DNA
gctgctaatcctagtacggag

SEQ ID NO: 3224 - DNA, 21 bp, synthetic construct
  misc_feature 1..21: note = n-mer motif encoding polynucleotide
  source 1..21: mol_type = other DNA
atgttggtacaaaacacaccc

SEQ ID NO: 3225 - DNA, 21 bp, synthetic construct
  misc_feature 1..21: note = n-mer motif encoding polynucleotide
  source 1..21: mol_type = other DNA
gtgcagcagaataatattaat

SEQ ID NO: 3226 - DNA, 21 bp, synthetic construct
  misc_feature 1..21: note = n-mer motif encoding polynucleotide
  source 1..21: mol_type = other DNA
catgatggttatgttcctaat

SEQ ID NO: 3227 - DNA, 21 bp, synthetic construct
  misc_feature 1..21: note = n-mer motif encoding polynucleotide
  source 1..21: mol_type = other DNA
aactcaggtaacaaccccatc

SEQ ID NO: 3228 - DNA, 21 bp, synthetic construct
  misc_feature 1..21: note = n-mer motif encoding polynucleotide
  source 1..21: mol_type = other DNA
acggacaacccgtcctacaaa

SEQ ID NO: 3229 - DNA, 21 bp, synthetic construct
  misc_feature 1..21: note = n-mer motif encoding polynucleotide
  source 1..21: mol_type = other DNA
ggaggcttaagtttatcctcg

SEQ ID NO: 3230 - DNA, 21 bp, synthetic construct
  misc_feature 1..21: note = n-mer motif encoding polynucleotide
  source 1..21: mol_type = other DNA
aataatgagaatacgcgtaat

SEQ ID NO: 3231 - DNA, 21 bp, synthetic construct
  misc_feature 1..21: note = n-mer motif encoding polynucleotide
  source 1..21: mol_type = other DNA
aagaataataattctgattct

SEQ ID NO: 3232 - DNA, 21 bp, synthetic construct
  misc_feature 1..21: note = n-mer motif encoding polynucleotide
  source 1..21: mol_type = other DNA
aaggatgagcatcttcattat

SEQ ID NO: 3233 - DNA, 21 bp, synthetic construct
  misc_feature 1..21: note = n-mer motif encoding polynucleotide
  source 1..21: mol_type = other DNA
aattttactattacggaggcg

SEQ ID NO: 3234 - DNA, 21 bp, synthetic construct
  misc_feature 1..21: note = n-mer motif encoding polynucleotide
  source 1..21: mol_type = other DNA
ttgaaccaaaacagtgtctcc

SEQ ID NO: 3235 - DNA, 21 bp, synthetic construct
  misc_feature 1..21: note = n-mer motif encoding polynucleotide
  source 1..21: mol_type = other DNA
aattctcatgttcctaataat

SEQ ID NO: 3236 - DNA, 21 bp, synthetic construct
  misc_feature 1..21: note = n-mer motif encoding polynucleotide
  source 1..21: mol_type = other DNA
aattctacgcatattaattcg

SEQ ID NO: 3237 - DNA, 21 bp, synthetic construct
  misc_feature 1..21: note = n-mer motif encoding polynucleotide
  source 1..21: mol_type = other DNA
catatgtctagttattcgtcg

SEQ ID NO: 3238 - DNA, 21 bp, synthetic construct
  misc_feature 1..21: note = n-mer motif encoding polynucleotide
  source 1..21: mol_type = other DNA
aacgtacccaacggacaagga

SEQ ID NO: 3239 - DNA, 21 bp, synthetic construct
  misc_feature 1..21: note = n-mer motif encoding polynucleotide
  source 1..21: mol_type = other DNA
aacggtccgaccggatccgcc

SEQ ID NO: 3240 - DNA, 21 bp, synthetic construct
  misc_feature 1..21: note = n-mer motif encoding polynucleotide
  source 1..21: mol_type = other DNA
aaaagcaacgcgggattcggt

SEQ ID NO: 3241 - DNA, 21 bp, synthetic construct
  misc_feature 1..21: note = n-mer motif encoding polynucleotide
  source 1..21: mol_type = other DNA
gcggccgcactagaaacaata

SEQ ID NO: 3242 - DNA, 21 bp, synthetic construct
  misc_feature 1..21: note = n-mer motif encoding polynucleotide
  source 1..21: mol_type = other DNA
aaccgtcaaagggacttcgaa

SEQ ID NO: 3243 - DNA, 21 bp, synthetic construct
  misc_feature 1..21: note = n-mer motif encoding polynucleotide
  source 1..21: mol_type = other DNA
gggtcagggaacgaacccggg

SEQ ID NO: 3244 - DNA, 21 bp, synthetic construct
  misc_feature 1..21: note = n-mer motif encoding polynucleotide
  source 1..21: mol_type = other DNA
gttagtgtggctgtgcctgcg

SEQ ID NO: 3245 - DNA, 21 bp, synthetic construct
  misc_feature 1..21: note = n-mer motif encoding polynucleotide
  source 1..21: mol_type = other DNA
cactctaacacacactacgaa

SEQ ID NO: 3246 - DNA, 21 bp, synthetic construct
  misc_feature 1..21: note = n-mer motif encoding polynucleotide
  source 1..21: mol_type = other DNA
cctgacagagcgaacgacaaa

SEQ ID NO: 3247 - DNA, 21 bp, synthetic construct
  misc_feature 1..21: note = n-mer motif encoding polynucleotide
  source 1..21: mol_type = other DNA
caagttggggctctaatggtt

SEQ ID NO: 3248 - DNA, 21 bp, synthetic construct
  misc_feature 1..21: note = n-mer motif encoding polynucleotide
  source 1..21: mol_type = other DNA
ttaacaccccaagggactagt

SEQ ID NO: 3249 - DNA, 21 bp, synthetic construct
  misc_feature 1..21: note = n-mer motif encoding polynucleotide
  source 1..21: mol_type = other DNA
ctatacgacggaaaacacgtc

SEQ ID NO: 3250 - DNA, 21 bp, synthetic construct
  misc_feature 1..21: note = n-mer motif encoding polynucleotide
  source 1..21: mol_type = other DNA
ctaaccgaatctgtgagaaac

SEQ ID NO: 3251 - DNA, 21 bp, synthetic construct
  misc_feature 1..21: note = n-mer motif encoding polynucleotide
  source 1..21: mol_type = other DNA
agtacttatgggaatacttat

SEQ ID NO: 3252 - DNA, 21 bp, synthetic construct
  misc_feature 1..21: note = n-mer motif encoding polynucleotide
  source 1..21: mol_type = other DNA
aatgctatttctactaataat

SEQ ID NO: 3253 - DNA, 21 bp, synthetic construct
  misc_feature 1..21: note = n-mer motif encoding polynucleotide
  source 1..21: mol_type = other DNA
attgctcatgtgtctactaat

SEQ ID NO: 3254 - DNA, 21 bp, synthetic construct
  misc_feature 1..21: note = n-mer motif encoding polynucleotide
  source 1..21: mol_type = other DNA
agtgaggagaggacgcgtgcg

SEQ ID NO: 3255 - DNA, 21 bp, synthetic construct
  misc_feature 1..21: note = n-mer motif encoding polynucleotide
  source 1..21: mol_type = other DNA
cgttggtctgaaaacaactcc

SEQ ID NO: 3256 - DNA, 21 bp, synthetic construct
  misc_feature 1..21: note = n-mer motif encoding polynucleotide
  source 1..21: mol_type = other DNA
gatggtaataatacgacttat

SEQ ID NO: 3257 - DNA, 21 bp, synthetic construct
  misc_feature 1..21: note = n-mer motif encoding polynucleotide
  source 1..21: mol_type = other DNA
gtgacgactgttgatagtgct

SEQ ID NO: 3258 - DNA, 21 bp, synthetic construct
  misc_feature 1..21: note = n-mer motif encoding polynucleotide
  source 1..21: mol_type = other DNA
accgtaaaacaaacaagtccg

SEQ ID NO: 3259 - DNA, 21 bp, synthetic construct
  misc_feature 1..21: note = n-mer motif encoding polynucleotide
  source 1..21: mol_type = other DNA
tctatctacctcgcgtccact

SEQ ID NO: 3260 - DNA, 21 bp, synthetic construct
  misc_feature 1..21: note = n-mer motif encoding polynucleotide
  source 1..21: mol_type = other DNA
acgacccgaaacgaacactcg

SEQ ID NO: 3261 - DNA, 21 bp, synthetic construct
  misc_feature 1..21: note = n-mer motif encoding polynucleotide
  source 1..21: mol_type = other DNA
tcgtatgatatgcatacgaat

SEQ ID NO: 3262 - DNA, 21 bp, synthetic construct
  misc_feature 1..21: note = n-mer motif encoding polynucleotide
  source 1..21: mol_type = other DNA
gtctctacatacctcctggca

SEQ ID NO: 3263 - DNA, 21 bp, synthetic construct
  misc_feature 1..21: note = n-mer motif encoding polynucleotide
  source 1..21: mol_type = other DNA
ggagaacaaagccacaaccaa

SEQ ID NO: 3264 - DNA, 21 bp, synthetic construct
  misc_feature 1..21: note = n-mer motif encoding polynucleotide
  source 1..21: mol_type = other DNA
actgccaacaaccactctccg

SEQ ID NO: 3265 - DNA, 21 bp, synthetic construct
  misc_feature 1..21: note = n-mer motif encoding polynucleotide
  source 1..21: mol_type = other DNA
caattccacgggacatctgaa

SEQ ID NO: 3266 - DNA, 21 bp, synthetic construct
  misc_feature 1..21: note = n-mer motif encoding polynucleotide
  source 1..21: mol_type = other DNA
aacgttctgggagcgtctagc

SEQ ID NO: 3267 - DNA, 21 bp, synthetic construct
  misc_feature 1..21: note = n-mer motif encoding polynucleotide
  source 1..21: mol_type = other DNA
agggatagtactattagtcgg

SEQ ID NO: 3268 - DNA, 21 bp, synthetic construct
  misc_feature 1..21: note = n-mer motif encoding polynucleotide
  source 1..21: mol_type = other DNA
gttattgggacttctagggat

SEQ ID NO: 3269 - DNA, 21 bp, synthetic construct
  misc_feature 1..21: note = n-mer motif encoding polynucleotide
  source 1..21: mol_type = other DNA
aattatgagaaggagtttgtt

SEQ ID NO: 3270 - DNA, 21 bp, synthetic construct
  misc_feature 1..21: note = n-mer motif encoding polynucleotide
  source 1..21: mol_type = other DNA
atggaccaaagccactcccga

SEQ ID NO: 3271 - DNA, 21 bp, synthetic construct
  misc_feature 1..21: note = n-mer motif encoding polynucleotide
  source 1..21: mol_type = other DNA
aattctcagaatcctcagggt

SEQ ID NO: 3272 - DNA, 21 bp, synthetic construct
  misc_feature 1..21: note = n-mer motif encoding polynucleotide
  source 1..21: mol_type = other DNA
cacacgggcacggacaaccga

SEQ ID NO: 3273 - DNA, 21 bp, synthetic construct
  misc_feature 1..21: note = n-mer motif encoding polynucleotide
  source 1..21: mol_type = other DNA
tataatactgttgatcagcgg

SEQ ID NO: 3274 - DNA, 21 bp, synthetic construct
  misc_feature 1..21: note = n-mer motif encoding polynucleotide
  source 1..21: mol_type = other DNA
aaagaaagcctcgaagacgtc

SEQ ID NO: 3275 - DNA, 21 bp, synthetic construct
  misc_feature 1..21: note = n-mer motif encoding polynucleotide
  source 1..21: mol_type = other DNA
actgcgaatagtacgtatgtg

SEQ ID NO: 3276 - DNA, 21 bp, synthetic construct
  misc_feature 1..21: note = n-mer motif encoding polynucleotide
  source 1..21: mol_type = other DNA
tatctgaatagtacgcagatt

SEQ ID NO: 3277 - DNA, 21 bp, synthetic construct
  misc_feature 1..21: note = n-mer motif encoding polynucleotide
  source 1..21: mol_type = other DNA
cgtgttgaagacaccaactcc

SEQ ID NO: 3278 - DNA, 21 bp, synthetic construct
  misc_feature 1..21: note = n-mer motif encoding polynucleotide
  source 1..21: mol_type = other DNA
aacgacgcacgcaaccgtgca

SEQ ID NO: 3279 - DNA, 21 bp, synthetic construct
  misc_feature 1..21: note = n-mer motif encoding polynucleotide
  source 1..21: mol_type = other DNA
aatactaataatcaggagcag

SEQ ID NO: 3280 - DNA, 21 bp, synthetic construct
  misc_feature 1..21: note = n-mer motif encoding polynucleotide
  source 1..21: mol_type = other DNA
accgtcggatcgaacagtata

SEQ ID NO: 3281 - DNA, 21 bp, synthetic construct
  misc_feature 1..21: note = n-mer motif encoding polynucleotide
  source 1..21: mol_type = other DNA
tatggggagcgtgctaggacg

SEQ ID NO: 3282 - DNA, 21 bp, synthetic construct
  misc_feature 1..21: note = n-mer motif encoding polynucleotide
  source 1..21: mol_type = other DNA
ccgaccggaggctcaccacca

SEQ ID NO: 3283 - DNA, 21 bp, synthetic construct
  misc_feature 1..21: note = n-mer motif encoding polynucleotide
  source 1..21: mol_type = other DNA
cttgggcaggttaattctacg

SEQ ID NO: 3284 - DNA, 21 bp, synthetic construct
  misc_feature 1..21: note = n-mer motif encoding polynucleotide
  source 1..21: mol_type = other DNA
gtctcgggtccggtatcggtc

SEQ ID NO: 3285 - DNA, 21 bp, synthetic construct
  misc_feature 1..21: note = n-mer motif encoding polynucleotide
  source 1..21: mol_type = other DNA
ggtactaatcatgatttttcg

SEQ ID NO: 3286 - DNA, 21 bp, synthetic construct
  misc_feature 1..21: note = n-mer motif encoding polynucleotide
  source 1..21: mol_type = other DNA
aagacgcttgataataatgct

SEQ ID NO: 3287 - DNA, 21 bp, synthetic construct
  misc_feature 1..21: note = n-mer motif encoding polynucleotide
  source 1..21: mol_type = other DNA
cacagtgaactacgtcaaaac

SEQ ID NO: 3288 - DNA, 21 bp, synthetic construct
  misc_feature 1..21: note = n-mer motif encoding polynucleotide
  source 1..21: mol_type = other DNA
gagaagaatctgactaatgct

SEQ ID NO: 3289 - DNA, 21 bp, synthetic construct
  misc_feature 1..21: note = n-mer motif encoding polynucleotide
  source 1..21: mol_type = other DNA
accggactcggaggcaacagt

SEQ ID NO: 3290 - DNA, 21 bp, synthetic construct
  misc_feature 1..21: note = n-mer motif encoding polynucleotide
  source 1..21: mol_type = other DNA
aaagaccacatcctcagcctc

SEQ ID NO: 3291 - DNA, 21 bp, synthetic construct
  misc_feature 1..21: note = n-mer motif encoding polynucleotide
  source 1..21: mol_type = other DNA
ataactactggcggagtgcta

SEQ ID NO: 3292 - DNA, 21 bp, synthetic construct
  misc_feature 1..21: note = n-mer motif encoding polynucleotide
  source 1..21: mol_type = other DNA
ctggctgattcgaattctaag

SEQ ID NO: 3293 - DNA, 21 bp, synthetic construct
  misc_feature 1..21: note = n-mer motif encoding polynucleotide
  source 1..21: mol_type = other DNA
agtatttctgataagaatcag

SEQ ID NO: 3294 - DNA, 21 bp, synthetic construct
  misc_feature 1..21: note = n-mer motif encoding polynucleotide
  source 1..21: mol_type = other DNA
tatattgctgggggggagcag

SEQ ID NO: 3295 - DNA, 21 bp, synthetic construct
  misc_feature 1..21: note = n-mer motif encoding polynucleotide
  source 1..21: mol_type = other DNA
ttgccggataaggggcggatt

SEQ ID NO: 3296 - DNA, 21 bp, synthetic construct
  misc_feature 1..21: note = n-mer motif encoding polynucleotide
  source 1..21: mol_type = other DNA
ttgatccaaacgcaaggcacg

SEQ ID NO: 3297 - DNA, 21 bp, synthetic construct
  misc_feature 1..21: note = n-mer motif encoding polynucleotide
  source 1..21: mol_type = other DNA
tactccggagaactaaacaaa

SEQ ID NO: 3298 - DNA, 21 bp, synthetic construct
  misc_feature 1..21: note = n-mer motif encoding polynucleotide
  source 1..21: mol_type = other DNA
tgcgcatcagaagtttgccaa

SEQ ID NO: 3299 - DNA, 21 bp, synthetic construct
  misc_feature 1..21: note = n-mer motif encoding polynucleotide
  source 1..21: mol_type = other DNA
cttatggctgctaatactgcg

SEQ ID NO: 3300 - DNA, 21 bp, synthetic construct
  misc_feature 1..21: note = n-mer motif encoding polynucleotide
  source 1..21: mol_type = other DNA
catcagtcttttgatgctggt

SEQ ID NO: 3301 - DNA, 21 bp, synthetic construct
  misc_feature 1..21: note = n-mer motif encoding polynucleotide
  source 1..21: mol_type = other DNA
ggggagacgctgaggtctcag

SEQ ID NO: 3302 - DNA, 21 bp, synthetic construct
  misc_feature 1..21: note = n-mer motif encoding polynucleotide
  source 1..21: mol_type = other DNA
cagactgatggtcctaatttt

SEQ ID NO: 3303 - DNA, 21 bp, synthetic construct
  misc_feature 1..21: note = n-mer motif encoding polynucleotide
  source 1..21: mol_type = other DNA
acgacgactaatgtgaatttt

SEQ ID NO: 3304 - DNA, 21 bp, synthetic construct
  misc_feature 1..21: note = n-mer motif encoding polynucleotide
  source 1..21: mol_type = other DNA
aacatgaccaacgaaaacgga

SEQ ID NO: 3305 - DNA, 21 bp, synthetic construct
  misc_feature 1..21: note = n-mer motif encoding polynucleotide
  source 1..21: mol_type = other DNA
gggtatagtccttcgacgccg

SEQ ID NO: 3306 - DNA, 21 bp, synthetic construct
  misc_feature 1..21: note = n-mer motif encoding polynucleotide
  source 1..21: mol_type = other DNA
ttgcaggttacggttcataat

SEQ ID NO: 3307 - DNA, 21 bp, synthetic construct
  misc_feature 1..21: note = n-mer motif encoding polynucleotide
  source 1..21: mol_type = other DNA
gatctgacgcatgttcatcgt

SEQ ID NO: 3308 - DNA, 21 bp, synthetic construct
  misc_feature 1..21: note = n-mer motif encoding polynucleotide
  source 1..21: mol_type = other DNA
acggagcttagtgagtatact

SEQ ID NO: 3309 - DNA, 21 bp, synthetic construct
  misc_feature 1..21: note = n-mer motif encoding polynucleotide
  source 1..21: mol_type = other DNA
atgacagtcgccagtactagc

SEQ ID NO: 3310 - DNA, 21 bp, synthetic construct
  misc_feature 1..21: note = n-mer motif encoding polynucleotide
  source 1..21: mol_type = other DNA
agcagtcaagcccacggccca

SEQ ID NO: 3311 - DNA, 21 bp, synthetic construct
  misc_feature 1..21: note = n-mer motif encoding polynucleotide
  source 1..21: mol_type = other DNA
accagaagcccgaacgaagac

SEQ ID NO: 3312 - DNA, 21 bp, synthetic construct
  misc_feature 1..21: note = n-mer motif encoding polynucleotide
  source 1..21: mol_type = other DNA
gataataataagcatggtact

SEQ ID NO: 3313 - DNA, 21 bp, synthetic construct
  misc_feature 1..21: note = n-mer motif encoding polynucleotide
  source 1..21: mol_type = other DNA
agggagattgttcatagtaat

SEQ ID NO: 3314 - DNA, 21 bp, synthetic construct
  misc_feature 1..21: note = n-mer motif encoding polynucleotide
  source 1..21: mol_type = other DNA
cggaaacttgaactcgaccta

SEQ ID NO: 3315 - DNA, 21 bp, synthetic construct
  misc_feature 1..21: note = n-mer motif encoding polynucleotide
  source 1..21: mol_type = other DNA
atctacgaaaccgtaaccttg

SEQ ID NO: 3316 - DNA, 21 bp, synthetic construct
  misc_feature 1..21: note = n-mer motif encoding polynucleotide
  source 1..21: mol_type = other DNA
aatagtggtagtacgagtttt

SEQ ID NO: 3317 - DNA, 21 bp, synthetic construct
  misc_feature 1..21: note = n-mer motif encoding polynucleotide
  source 1..21: mol_type = other DNA
ccaagtacgaacgaaagccgc

SEQ ID NO: 3318 - DNA, 21 bp, synthetic construct
  misc_feature 1..21: note = n-mer motif encoding polynucleotide
  source 1..21: mol_type = other DNA
caagccgacctcaggtacaaa

SEQ ID NO: 3319 - DNA, 21 bp, synthetic construct
  misc_feature 1..21: note = n-mer motif encoding polynucleotide
  source 1..21: mol_type = other DNA
gatcagccggggtatgtgcgt

SEQ ID NO: 3320 - DNA, 21 bp, synthetic construct
  misc_feature 1..21: note = n-mer motif encoding polynucleotide
  source 1..21: mol_type = other DNA
gatgctatgcttgctcatccg

SEQ ID NO: 3321 - DNA, 21 bp, synthetic construct
  misc_feature 1..21: note = n-mer motif encoding polynucleotide
  source 1..21: mol_type = other DNA
acacgtcacgacggcagtacg

SEQ ID NO: 3322 - DNA, 21 bp, synthetic construct
  misc_feature 1..21: note = n-mer motif encoding polynucleotide
  source 1..21: mol_type = other DNA
ctggcgaatatgagtgcgccg

SEQ ID NO: 3323 - DNA, 21 bp, synthetic construct
  misc_feature 1..21: note = n-mer motif encoding polynucleotide
  source 1..21: mol_type = other DNA
actggtcatccgccggcggcg

SEQ ID NO: 3324 - DNA, 21 bp, synthetic construct
  misc_feature 1..21: note = n-mer motif encoding polynucleotide
  source 1..21: mol_type = other DNA
tcgagtattagtctgcggtat

SEQ ID NO: 3325 - DNA, 21 bp, synthetic construct
  misc_feature 1..21: note = n-mer motif encoding polynucleotide
  source 1..21: mol_type = other DNA
atgcacgtcgacaaaacgagt

SEQ ID NO: 3326 - DNA, 21 bp, synthetic construct
  misc_feature 1..21: note = n-mer motif encoding polynucleotide
  source 1..21: mol_type = other DNA
gggagtgattctaagcatcct

SEQ ID NO: 3327 - DNA, 21 bp, synthetic construct
  misc_feature 1..21: note = n-mer motif encoding polynucleotide
  source 1..21: mol_type = other DNA
ggagaaagctcctcaataagc

SEQ ID NO: 3328 - DNA, 21 bp, synthetic construct
  misc_feature 1..21: note = n-mer motif encoding polynucleotide
  source 1..21: mol_type = other DNA
gtcgtccactcacacagtgaa

SEQ ID NO: 3329 - DNA, 21 bp, synthetic construct
  misc_feature 1..21: note = n-mer motif encoding polynucleotide
  source 1..21: mol_type = other DNA
agtgtgcgggcgcatgttttg

SEQ ID NO: 3330 - DNA, 21 bp, synthetic construct
  misc_feature 1..21: note = n-mer motif encoding polynucleotide
  source 1..21: mol_type = other DNA
gcggatggggctaagtctgct

SEQ ID NO: 3331 - DNA, 21 bp, synthetic construct
  misc_feature 1..21: note = n-mer motif encoding polynucleotide
  source 1..21: mol_type = other DNA
ggggaagcacgccgagaagcc

SEQ ID NO: 3332 - DNA, 21 bp, synthetic construct
  misc_feature 1..21: note = n-mer motif encoding polynucleotide
  source 1..21: mol_type = other DNA
tttaatgctacggtggtgcat

SEQ ID NO: 3333 - DNA, 21 bp, synthetic construct
  misc_feature 1..21: note = n-mer motif encoding polynucleotide
  source 1..21: mol_type = other DNA
tggacggaagggggctcagga

SEQ ID NO: 3334 - DNA, 21 bp, synthetic construct
  misc_feature 1..21: note = n-mer motif encoding polynucleotide
  source 1..21: mol_type = other DNA
gattcttcttatacgcatccg

SEQ ID NO: 3335 - DNA, 21 bp, synthetic construct
  misc_feature 1..21: note = n-mer motif encoding polynucleotide
  source 1..21: mol_type = other DNA
ttcccaagtagggacaacgta

SEQ ID NO: 3336 - DNA, 21 bp, synthetic construct
  misc_feature 1..21: note = n-mer motif encoding polynucleotide
  source 1..21: mol_type = other DNA
gccatcacgcacatcggtaca

SEQ ID NO: 3337 - DNA, 21 bp, synthetic construct
  misc_feature 1..21: note = n-mer motif encoding polynucleotide
  source 1..21: mol_type = other DNA
gcttttaagtcgggtagtatt

SEQ ID NO: 3338 - DNA, 21 bp, synthetic construct
  misc_feature 1..21: note = n-mer motif encoding polynucleotide
  source 1..21: mol_type = other DNA
atgtcaaacgcctcctacata

SEQ ID NO: 3339 - DNA, 21 bp, synthetic construct
  misc_feature 1..21: note = n-mer motif encoding polynucleotide
  source 1..21: mol_type = other DNA
gcggagaggaatgataggacg

SEQ ID NO: 3340 - DNA, 21 bp, synthetic construct
  misc_feature 1..21: note = n-mer motif encoding polynucleotide
  source 1..21: mol_type = other DNA
acattagaaacaacccgcagc

SEQ ID NO: 3341 - DNA, 21 bp, synthetic construct
  misc_feature 1..21: note = n-mer motif encoding polynucleotide
  source 1..21: mol_type = other DNA
cgcttacacggctcagactcg

SEQ ID NO: 3342 - DNA, 21 bp, synthetic construct
  misc_feature 1..21: note = n-mer motif encoding polynucleotide
  source 1..21: mol_type = other DNA
tatgaggggcatatgaatact

SEQ ID NO: 3343 - DNA, 21 bp, synthetic construct
  misc_feature 1..21: note = n-mer motif encoding polynucleotide
  source 1..21: mol_type = other DNA
tctgtgacgactaatctgatg

SEQ ID NO: 3344 - DNA, 21 bp, synthetic construct
  misc_feature 1..21: note = n-mer motif encoding polynucleotide
  source 1..21: mol_type = other DNA
ttgcgtgatcagactagtatg

SEQ ID NO: 3345 - DNA, 21 bp, synthetic construct
  misc_feature 1..21: note = n-mer motif encoding polynucleotide
  source 1..21: mol_type = other DNA
cccgccagtcacagcgcggga

SEQ ID NO: 3346 - DNA, 21 bp, synthetic construct
  misc_feature 1..21: note = n-mer motif encoding polynucleotide
  source 1..21: mol_type = other DNA
gtggttgagaatttgaggcag

SEQ ID NO: 3347 - DNA, 21 bp, synthetic construct
  misc_feature 1..21: note = n-mer motif encoding polynucleotide
  source 1..21: mol_type = other DNA
caacaatcacaaaactctata

SEQ ID NO: 3348 - DNA, 21 bp, synthetic construct
  misc_feature 1..21: note = n-mer motif encoding polynucleotide
  source 1..21: mol_type = other DNA
cttgttgatacggataggaat

SEQ ID NO: 3349 - DNA, 21 bp, synthetic construct
  misc_feature 1..21: note = n-mer motif encoding polynucleotide
  source 1..21: mol_type = other DNA
aacgaaatgggaaactacgtc

SEQ ID NO: 3350 - DNA, 21 bp, synthetic construct
  misc_feature 1..21: note = n-mer motif encoding polynucleotide
  source 1..21: mol_type = other DNA
tccaccgacccccgatactca

SEQ ID NO: 3351 - DNA, 21 bp, synthetic construct
  misc_feature 1..21: note = n-mer motif encoding polynucleotide
  source 1..21: mol_type = other DNA
actaatggtatttatcagcct

SEQ ID NO: 3352 - DNA, 21 bp, synthetic construct
  misc_feature 1..21: note = n-mer motif encoding polynucleotide
  source 1..21: mol_type = other DNA
tgggtaaacagtgtgggcaac

SEQ ID NO: 3353 - DNA, 21 bp, synthetic construct
  misc_feature 1..21: note = n-mer motif encoding polynucleotide
  source 1..21: mol_type = other DNA
ggggtatctaacaactctagc

SEQ ID NO: 3354 - DNA, 21 bp, synthetic construct
  misc_feature 1..21: note = n-mer motif encoding polynucleotide
  source 1..21: mol_type = other DNA
aatgttaatgcgcagagtagg

SEQ ID NO: 3355 - DNA, 21 bp, synthetic construct
  misc_feature 1..21: note = n-mer motif encoding polynucleotide
  source 1..21: mol_type = other DNA
acgacgccgcctttttctaat

SEQ ID NO: 3356 - DNA, 21 bp, synthetic construct
  misc_feature 1..21: note = n-mer motif encoding polynucleotide
  source 1..21: mol_type = other DNA
acaggcagctcccacaccaac

SEQ ID NO: 3357 - DNA, 21 bp, synthetic construct
  misc_feature 1..21: note = n-mer motif encoding polynucleotide
  source 1..21: mol_type = other DNA
tacgtcgacaaatcaatgaca

SEQ ID NO: 3358 - DNA, 21 bp, synthetic construct
  misc_feature 1..21: note = n-mer motif encoding polynucleotide
  source 1..21: mol_type = other DNA
ctaatcaaaaacaacatgctc

SEQ ID NO: 3359 - DNA, 21 bp, synthetic construct
  misc_feature 1..21: note = n-mer motif encoding polynucleotide
  source 1..21: mol_type = other DNA
gggggtacggggttgtcgaag

SEQ ID NO: 3360 - DNA, 21 bp, synthetic construct
  misc_feature 1..21: note = n-mer motif encoding polynucleotide
  source 1..21: mol_type = other DNA
gctcttcataatctgatgaat

SEQ ID NO: 3361 - DNA, 21 bp, synthetic construct
  misc_feature 1..21: note = n-mer motif encoding polynucleotide
  source 1..21: mol_type = other DNA
gtgcatgtgactaatgtgttg

SEQ ID NO: 3362 - DNA, 21 bp, synthetic construct
  misc_feature 1..21: note = n-mer motif encoding polynucleotide
  source 1..21: mol_type = other DNA
tcgacgacgcacccttccgaa

SEQ ID NO: 3363 - DNA, 21 bp, synthetic construct
  misc_feature 1..21: note = n-mer motif encoding polynucleotide
  source 1..21: mol_type = other DNA
agcgtaggtagtccaacacac

SEQ ID NO: 3364 - DNA, 21 bp, synthetic construct
  misc_feature 1..21: note = n-mer motif encoding polynucleotide
  source 1..21: mol_type = other DNA
atgagtaatgatttgcctggg

SEQ ID NO: 3365 - DNA, 21 bp, synthetic construct
  misc_feature 1..21: note = n-mer motif encoding polynucleotide
  source 1..21: mol_type = other DNA
ttctcgtcaaccgaagccaga

SEQ ID NO: 3366 - DNA, 21 bp, synthetic construct
  misc_feature 1..21: note = n-mer motif encoding polynucleotide
  source 1..21: mol_type = other DNA
gccggtcaccaacaactggcc

SEQ ID NO: 3367 - DNA, 21 bp, synthetic construct
  misc_feature 1..21: note = n-mer motif encoding polynucleotide
  source 1..21: mol_type = other DNA
ggtaccatattaccaaaccaa

SEQ ID NO: 3368 - DNA, 21 bp, synthetic construct
  misc_feature 1..21: note = n-mer motif encoding polynucleotide
  source 1..21: mol_type = other DNA
agcgcggtttctggtagcagc

SEQ ID NO: 3369 - DNA, 21 bp, synthetic construct
  misc_feature 1..21: note = n-mer motif encoding polynucleotide
  source 1..21: mol_type = other DNA
gaggtgtctagggatggtctg

SEQ ID NO: 3370 - DNA, 21 bp, synthetic construct
  misc_feature 1..21: note = n-mer motif encoding polynucleotide
  source 1..21: mol_type = other DNA
caatcactcaaagacggcact

SEQ ID NO: 3371 - DNA, 21 bp, synthetic construct
  misc_feature 1..21: note = n-mer motif encoding polynucleotide
  source 1..21: mol_type = other DNA
acgcgtgagggtaatcatgct

SEQ ID NO: 3372 - DNA, 21 bp, synthetic construct
  misc_feature 1..21: note = n-mer motif encoding polynucleotide
  source 1..21: mol_type = other DNA
gtggcgacccaaaaccttctt

SEQ ID NO: 3373 - DNA, 21 bp, synthetic construct
  misc_feature 1..21: note = n-mer motif encoding polynucleotide
  source 1..21: mol_type = other DNA
gccgaaatgacgcaccgcctc

SEQ ID NO: 3374 - DNA, 21 bp, synthetic construct
  misc_feature 1..21: note = n-mer motif encoding polynucleotide
  source 1..21: mol_type = other DNA
caacggccagacccgcttaaa

SEQ ID NO: 3375 - DNA, 21 bp, synthetic construct
  misc_feature 1..21: note = n-mer motif encoding polynucleotide
  source 1..21: mol_type = other DNA
gaacacatctctagctacgga

SEQ ID NO: 3376 - DNA, 21 bp, synthetic construct
  misc_feature 1..21: note = n-mer motif encoding polynucleotide
  source 1..21: mol_type = other DNA
caaaaaagcaacgaccaaaac

SEQ ID NO: 3377 - DNA, 21 bp, synthetic construct
  misc_feature 1..21: note = n-mer motif encoding polynucleotide
  source 1..21: mol_type = other DNA
aatcttgtgatgagtgggacg

SEQ ID NO: 3378 - DNA, 21 bp, synthetic construct
  misc_feature 1..21: note = n-mer motif encoding polynucleotide
  source 1..21: mol_type = other DNA
ggagcgggacaatctcacgtg

SEQ ID NO: 3379 - DNA, 21 bp, synthetic construct
  misc_feature 1..21: note = n-mer motif encoding polynucleotide
  source 1..21: mol_type = other DNA
ctcaaccacacaatgcccctc

SEQ ID NO: 3380 - DNA, 21 bp, synthetic construct
  misc_feature 1..21: note = n-mer motif encoding polynucleotide
  source 1..21: mol_type = other DNA
gtatcacaatcacacgacgtg

SEQ ID NO: 3381 - DNA, 21 bp, synthetic construct
  misc_feature 1..21: note = n-mer motif encoding polynucleotide
  source 1..21: mol_type = other DNA
gctaattctgctactaatcag

SEQ ID NO: 3382 - DNA, 21 bp, synthetic construct
  misc_feature 1..21: note = n-mer motif encoding polynucleotide
  source 1..21: mol_type = other DNA
ggcacaggaggtaaccgagaa

SEQ ID NO: 3383 - DNA, 21 bp, synthetic construct
  misc_feature 1..21: note = n-mer motif encoding polynucleotide
  source 1..21: mol_type = other DNA
gcgaagtcgtcgattattttg

SEQ ID NO: 3384 - DNA, 21 bp, synthetic construct
  misc_feature 1..21: note = n-mer motif encoding polynucleotide
  source 1..21: mol_type = other DNA
ggaggaacagcccttgggagc

SEQ ID NO: 3385 - DNA, 21 bp, synthetic construct
  misc_feature 1..21: note = n-mer motif encoding polynucleotide
  source 1..21: mol_type = other DNA
aacaaagtagaatctgaccca

SEQ ID NO: 3386 - DNA, 21 bp, synthetic construct
  misc_feature 1..21: note = n-mer motif encoding polynucleotide
  source 1..21: mol_type = other DNA
aactcgaaacaacccgacgtc

SEQ ID NO: 3387 - DNA, 21 bp, synthetic construct
  misc_feature 1..21: note = n-mer motif encoding polynucleotide
  source 1..21: mol_type = other DNA
agttatgctgatcgtcggctg

SEQ ID NO: 3388 - DNA, 21 bp, synthetic construct
  misc_feature 1..21: note = n-mer motif encoding polynucleotide
  source 1..21: mol_type = other DNA
aatgtgaatccgaatgggccg

SEQ ID NO: 3389 - DNA, 21 bp, synthetic construct
  misc_feature 1..21: note = n-mer motif encoding polynucleotide
  source 1..21: mol_type = other DNA
gaacacaactcaaaaacttac

SEQ ID NO: 3390 - DNA, 21 bp, synthetic construct
  misc_feature 1..21: note = n-mer motif encoding polynucleotide
  source 1..21: mol_type = other DNA
acccaaggatctaacaccaca

SEQ ID NO: 3391 - DNA, 21 bp, synthetic construct
  misc_feature 1..21: note = n-mer motif encoding polynucleotide
  source 1..21: mol_type = other DNA
agcaacgtatcagcttacgca

SEQ ID NO: 3392 - DNA, 21 bp, synthetic construct
  misc_feature 1..21: note = n-mer motif encoding polynucleotide
  source 1..21: mol_type = other DNA
gcgtacagtgacagcgcccgc

SEQ ID NO: 3393 - DNA, 21 bp, synthetic construct
  misc_feature 1..21: note = n-mer motif encoding polynucleotide
  source 1..21: mol_type = other DNA
gggtcgcaatacgcgaaccgc

SEQ ID NO: 3394 - DNA, 21 bp, synthetic construct
  misc_feature 1..21: note = n-mer motif encoding polynucleotide
  source 1..21: mol_type = other DNA
acaatgagcgtaactctggaa

SEQ ID NO: 3395 - DNA, 21 bp, synthetic construct
  misc_feature 1..21: note = n-mer motif encoding polynucleotide
  source 1..21: mol_type = other DNA
cagacgactattctggctgct

SEQ ID NO: 3396 - DNA, 21 bp, synthetic construct
  misc_feature 1..21: note = n-mer motif encoding polynucleotide
  source 1..21: mol_type = other DNA
ttgctccaatccatagtggta

SEQ ID NO: 3397 - DNA, 21 bp, synthetic construct
  misc_feature 1..21: note = n-mer motif encoding polynucleotide
  source 1..21: mol_type = other DNA
gttcacgctaacgctacatta

SEQ ID NO: 3398 - DNA, 21 bp, synthetic construct
  misc_feature 1..21: note = n-mer motif encoding polynucleotide
  source 1..21: mol_type = other DNA
aacaaaacaaacgccgactac

SEQ ID NO: 3399 - DNA, 21 bp, synthetic construct
  misc_feature 1..21: note = n-mer motif encoding polynucleotide
  source 1..21: mol_type = other DNA
aactacgacaccggcgccaaa

SEQ ID NO: 3400 - DNA, 21 bp, synthetic construct
  misc_feature 1..21: note = n-mer motif encoding polynucleotide
  source 1..21: mol_type = other DNA
gtctaccacaaccgcgacgtt

SEQ ID NO: 3401 - DNA, 21 bp, synthetic construct
  misc_feature 1..21: note = n-mer motif encoding polynucleotide
  source 1..21: mol_type = other DNA
gattctgctccgaggtctatt

SEQ ID NO: 3402 - DNA, 21 bp, synthetic construct
  misc_feature 1..21: note = n-mer motif encoding polynucleotide
  source 1..21: mol_type = other DNA
ttgattgcgaatctgagtaat

SEQ ID NO: 3403 - DNA, 21 bp, synthetic construct
  misc_feature 1..21: note = n-mer motif encoding polynucleotide
  source 1..21: mol_type = other DNA
ccgcaagacgtccgccaaaca

SEQ ID NO: 3404 - DNA, 21 bp, synthetic construct
  misc_feature 1..21: note = n-mer motif encoding polynucleotide
  source 1..21: mol_type = other DNA
acaatgacagcaatagcaatg

SEQ ID NO: 3405 - DNA, 21 bp, synthetic construct
  misc_feature 1..21: note = n-mer motif encoding polynucleotide
  source 1..21: mol_type = other DNA
acatacgcctctactgaagcg

SEQ ID NO: 3406 - DNA, 21 bp, synthetic construct
  misc_feature 1..21: note = n-mer motif encoding polynucleotide
  source 1..21: mol_type = other DNA
cctcacgccaacggagtgaca

SEQ ID NO: 3407 - DNA, 21 bp, synthetic construct
  misc_feature 1..21: note = n-mer motif encoding polynucleotide
  source 1..21: mol_type = other DNA
cgggctgatgtttcttggtct

SEQ ID NO: 3408 - DNA, 21 bp, synthetic construct
  misc_feature 1..21: note = n-mer motif encoding polynucleotide
  source 1..21: mol_type = other DNA
ctgacgcacatgaccggaacc

SEQ ID NO: 3409 - DNA, 21 bp, synthetic construct
  misc_feature 1..21: note = n-mer motif encoding polynucleotide
  source 1..21: mol_type = other DNA
gcaaacgactctgccaaaaca

SEQ ID NO: 3410 - DNA, 21 bp, synthetic construct
  misc_feature 1..21: note = n-mer motif encoding polynucleotide
  source 1..21: mol_type = other DNA
gctaattctgggttgcataat

SEQ ID NO: 3411 - DNA, 21 bp, synthetic construct
  misc_feature 1..21: note = n-mer motif encoding polynucleotide
  source 1..21: mol_type = other DNA
aacgtgggcaccgacagagac

SEQ ID NO: 3412 - DNA, 21 bp, synthetic construct
  misc_feature 1..21: note = n-mer motif encoding polynucleotide
  source 1..21: mol_type = other DNA
gtcggaacaacctcgaacggc

SEQ ID NO: 3413 - DNA, 21 bp, synthetic construct
  misc_feature 1..21: note = n-mer motif encoding polynucleotide
  source 1..21: mol_type = other DNA
ggagttcttgggatactggtc

SEQ ID NO: 3414 - DNA, 21 bp, synthetic construct
  misc_feature 1..21: note = n-mer motif encoding polynucleotide
  source 1..21: mol_type = other DNA
cgaatcaacgcagcaatcgac

SEQ ID NO: 3415 - DNA, 21 bp, synthetic construct
  misc_feature 1..21: note = n-mer motif encoding polynucleotide
  source 1..21: mol_type = other DNA
cccgacactcgcccatccata

SEQ ID NO: 3416 - DNA, 21 bp, synthetic construct
  misc_feature 1..21: note = n-mer motif encoding polynucleotide
  source 1..21: mol_type = other DNA
ggtgaatcacgtacaaacatg

SEQ ID NO: 3417 - DNA, 21 bp, synthetic construct
  misc_feature 1..21: note = n-mer motif encoding polynucleotide
  source 1..21: mol_type = other DNA
attttgcttgctcagtctgct

SEQ ID NO: 3418 - DNA, 21 bp, synthetic construct
  misc_feature 1..21: note = n-mer motif encoding polynucleotide
  source 1..21: mol_type = other DNA
tataatagggataatggttct

SEQ ID NO: 3419 - DNA, 21 bp, synthetic construct
  misc_feature 1..21: note = n-mer motif encoding polynucleotide
  source 1..21: mol_type = other DNA
tggaatagtccgggtgaggcg

SEQ ID NO: 3420 - DNA, 21 bp, synthetic construct
  misc_feature 1..21: note = n-mer motif encoding polynucleotide
  source 1..21: mol_type = other DNA
ctgttgggggctcatcagccg

SEQ ID NO: 3421 - DNA, 21 bp, synthetic construct
  misc_feature 1..21: note = n-mer motif encoding polynucleotide
  source 1..21: mol_type = other DNA
attggtaaggatagtgttccg

SEQ ID NO: 3422 - DNA, 21 bp, synthetic construct
  misc_feature 1..21: note = n-mer motif encoding polynucleotide
  source 1..21: mol_type = other DNA
acgcgggagagtctggtggat

SEQ ID NO: 3423 - DNA, 21 bp, synthetic construct
  misc_feature 1..21: note = n-mer motif encoding polynucleotide
  source 1..21: mol_type = other DNA
gcctctaaccacctacaagcc

SEQ ID NO: 3424 - DNA, 21 bp, synthetic construct
  misc_feature 1..21: note = n-mer motif encoding polynucleotide
  source 1..21: mol_type = other DNA
aatcttcagacgggtaaggct

SEQ ID NO: 3425 - DNA, 21 bp, synthetic construct
  misc_feature 1..21: note = n-mer motif encoding polynucleotide
  source 1..21: mol_type = other DNA
actgtaggatcctcatacgct

SEQ ID NO: 3426 - DNA, 21 bp, synthetic construct
  misc_feature 1..21: note = n-mer motif encoding polynucleotide
  source 1..21: mol_type = other DNA
gacactaacggaataaaatca

SEQ ID NO: 3427 - DNA, 21 bp, synthetic construct
  misc_feature 1..21: note = n-mer motif encoding polynucleotide
  source 1..21: mol_type = other DNA
agtctgcggatggagaatagt

SEQ ID NO: 3428 - DNA, 21 bp, synthetic construct
  misc_feature 1..21: note = n-mer motif encoding polynucleotide
  source 1..21: mol_type = other DNA
actaagggtaataatctggtt

SEQ ID NO: 3429 - DNA, 21 bp, synthetic construct
  misc_feature 1..21: note = n-mer motif encoding polynucleotide
  source 1..21: mol_type = other DNA
catacgaatcagatgcagcct

SEQ ID NO: 3430 - DNA, 21 bp, synthetic construct
  misc_feature 1..21: note = n-mer motif encoding polynucleotide
  source 1..21: mol_type = other DNA
aacggcaactacgacggcgcg

SEQ ID NO: 3431 - DNA, 21 bp, synthetic construct
  misc_feature 1..21: note = n-mer motif encoding polynucleotide
  source 1..21: mol_type = other DNA
gaggcgcataatcgtggtaat

SEQ ID NO: 3432 - DNA, 21 bp, synthetic construct
  misc_feature 1..21: note = n-mer motif encoding polynucleotide
  source 1..21: mol_type = other DNA
gggacggttaactcaagtgca

SEQ ID NO: 3433 - DNA, 21 bp, synthetic construct
  misc_feature 1..21: note = n-mer motif encoding polynucleotide
  source 1..21: mol_type = other DNA
gggccgacgatgaatcataat

SEQ ID NO: 3434 - DNA, 21 bp, synthetic construct
  misc_feature 1..21: note = n-mer motif encoding polynucleotide
  source 1..21: mol_type = other DNA
gtacccaacaacaacacttcg

SEQ ID NO: 3435 - DNA, 21 bp, synthetic construct
  misc_feature 1..21: note = n-mer motif encoding polynucleotide
  source 1..21: mol_type = other DNA
gtttctaacaaatctggaagt

SEQ ID NO: 3436 - DNA, 21 bp, synthetic construct
  misc_feature 1..21: note = n-mer motif encoding polynucleotide
  source 1..21: mol_type = other DNA
tggggagtcagtaactcagca

SEQ ID NO: 3437 - DNA, 21 bp, synthetic construct
  misc_feature 1..21: note = n-mer motif encoding polynucleotide
  source 1..21: mol_type = other DNA
gtctctaacgtcctctacagc

SEQ ID NO: 3438 - DNA, 21 bp, synthetic construct
  misc_feature 1..21: note = n-mer motif encoding polynucleotide
  source 1..21: mol_type = other DNA
gccggccaaaacagtgtgggc

SEQ ID NO: 3439 - DNA, 21 bp, synthetic construct
  misc_feature 1..21: note = n-mer motif encoding polynucleotide
  source 1..21: mol_type = other DNA
ggtacgagtctggagaatagg

SEQ ID NO: 3440 - DNA, 21 bp, synthetic construct
  misc_feature 1..21: note = n-mer motif encoding polynucleotide
  source 1..21: mol_type = other DNA
cagatgaatattcatgataag

SEQ ID NO: 3441 - DNA, 21 bp, synthetic construct
  misc_feature 1..21: note = n-mer motif encoding polynucleotide
  source 1..21: mol_type = other DNA
cctcaactaagcggcacagcg

SEQ ID NO: 3442 - DNA, 21 bp, synthetic construct
  misc_feature 1..21: note = n-mer motif encoding polynucleotide
  source 1..21: mol_type = other DNA
agttcgactccgcaggatact

SEQ ID NO: 3443 - DNA, 21 bp, synthetic construct
  misc_feature 1..21: note = n-mer motif encoding polynucleotide
  source 1..21: mol_type = other DNA
gtgcaggggcagaccggctgg

SEQ ID NO: 3444 - DNA, 21 bp, synthetic construct
  misc_feature 1..21: note = n-mer motif encoding polynucleotide
  source 1..21: mol_type = other DNA
ggtctgacgggtgatttggtt

SEQ ID NO: 3445 - DNA, 21 bp, synthetic construct
  misc_feature 1..21: note = n-mer motif encoding polynucleotide
  source 1..21: mol_type = other DNA
aaccaccccgcaccaagctca

SEQ ID NO: 3446 - DNA, 21 bp, synthetic construct
  misc_feature 1..21: note = n-mer motif encoding polynucleotide
  source 1..21: mol_type = other DNA
aaagaaaaaaccacccgcgaa

SEQ ID NO: 3447 - DNA, 21 bp, synthetic construct
  misc_feature 1..21: note = n-mer motif encoding polynucleotide
  source 1..21: mol_type = other DNA
actactaatccgcagacgcag

SEQ ID NO: 3448 - DNA, 21 bp, synthetic construct
  misc_feature 1..21: note = n-mer motif encoding polynucleotide
  source 1..21: mol_type = other DNA
ggaggtgaacacgcaagaaac

SEQ ID NO: 3449 - DNA, 21 bp, synthetic construct
  misc_feature 1..21: note = n-mer motif encoding polynucleotide
  source 1..21: mol_type = other DNA
acgaccgaagctgttgtagca

SEQ ID NO: 3450 - DNA, 21 bp, synthetic construct
  misc_feature 1..21: note = n-mer motif encoding polynucleotide
  source 1..21: mol_type = other DNA
caaaacagtgacctcgccagc

SEQ ID NO: 3451 - DNA, 21 bp, synthetic construct
  misc_feature 1..21: note = n-mer motif encoding polynucleotide
  source 1..21: mol_type = other DNA
tactctacagaagcacgagtc

SEQ ID NO: 3452 - DNA, 21 bp, synthetic construct
  misc_feature 1..21: note = n-mer motif encoding polynucleotide
  source 1..21: mol_type = other DNA
accggacaagcgggcggatcg

SEQ ID NO: 3453 - DNA, 21 bp, synthetic construct
  misc_feature 1..21: note = n-mer motif encoding polynucleotide
  source 1..21: mol_type = other DNA
acttcgtctaatctttatgtg

SEQ ID NO: 3454 - DNA, 21 bp, synthetic construct
  misc_feature 1..21: note = n-mer motif encoding polynucleotide
  source 1..21: mol_type = other DNA
acggctcgtgcgattgatatg

SEQ ID NO: 3455 - DNA, 21 bp, synthetic construct
  misc_feature 1..21: note = n-mer motif encoding polynucleotide
  source 1..21: mol_type = other DNA
caggagtctaataggggggtg

SEQ ID NO: 3456 - DNA, 21 bp, synthetic construct
  misc_feature 1..21: note = n-mer motif encoding polynucleotide
  source 1..21: mol_type = other DNA
agtatcggattctcagtaggc

SEQ ID NO: 3457 - DNA, 21 bp, synthetic construct
  misc_feature 1..21: note = n-mer motif encoding polynucleotide
  source 1..21: mol_type = other DNA
gagcggagtacgcataatgtt

SEQ ID NO: 3458 - DNA, 21 bp, synthetic construct
  misc_feature 1..21: note = n-mer motif encoding polynucleotide
  source 1..21: mol_type = other DNA
gcaaaccacgacaacatcgtg

SEQ ID NO: 3459 - DNA, 21 bp, synthetic construct
  misc_feature 1..21: note = n-mer motif encoding polynucleotide
  source 1..21: mol_type = other DNA
tgggctatgaataatgtgccg

SEQ ID NO: 3460 - DNA, 21 bp, synthetic construct
  misc_feature 1..21: note = n-mer motif encoding polynucleotide
  source 1..21: mol_type = other DNA
tatattgctgcgggtgagcag

SEQ ID NO: 3461 - DNA, 21 bp, synthetic construct
  misc_feature 1..21: note = n-mer motif encoding polynucleotide
  source 1..21: mol_type = other DNA
agttcgaatacttctggtagt

SEQ ID NO: 3462 - DNA, 21 bp, synthetic construct
  misc_feature 1..21: note = n-mer motif encoding polynucleotide
  source 1..21: mol_type = other DNA
atggggaagcatgagggtctt

SEQ ID NO: 3463 - DNA, 21 bp, synthetic construct
  misc_feature 1..21: note = n-mer motif encoding polynucleotide
  source 1..21: mol_type = other DNA
gtgcttactcatctgccgacg

SEQ ID NO: 3464 - DNA, 21 bp, synthetic construct
  misc_feature 1..21: note = n-mer motif encoding polynucleotide
  source 1..21: mol_type = other DNA
gaaatgggtaaccaataccca

SEQ ID NO: 3465 - DNA, 21 bp, synthetic construct
  misc_feature 1..21: note = n-mer motif encoding polynucleotide
  source 1..21: mol_type = other DNA
agtctgcgtccaaccctacct

SEQ ID NO: 3466 - DNA, 21 bp, synthetic construct
  misc_feature 1..21: note = n-mer motif encoding polynucleotide
  source 1..21: mol_type = other DNA
tcggctaacttatacaaacaa

SEQ ID NO: 3467 - DNA, 21 bp, synthetic construct
  misc_feature 1..21: note = n-mer motif encoding polynucleotide
  source 1..21: mol_type = other DNA
caaaacgacagaaaaccggac

SEQ ID NO: 3468 - DNA, 21 bp, synthetic construct
  misc_feature 1..21: note = n-mer motif encoding polynucleotide
  source 1..21: mol_type = other DNA
attatttcgggtattacggtg

SEQ ID NO: 3469 - DNA, 21 bp, synthetic construct
  misc_feature 1..21: note = n-mer motif encoding polynucleotide
  source 1..21: mol_type = other DNA
ccatccgaaatgagggccgta

SEQ ID NO: 3470 - DNA, 21 bp, synthetic construct
  misc_feature 1..21: note = n-mer motif encoding polynucleotide
  source 1..21: mol_type = other DNA
ttggttacgcagacgccgaat

SEQ ID NO: 3471 - DNA, 21 bp, synthetic construct
  misc_feature 1..21: note = n-mer motif encoding polynucleotide
  source 1..21: mol_type = other DNA
attgcgcagaatgagacgtat

SEQ ID NO: 3472 - DNA, 21 bp, synthetic construct
  misc_feature 1..21: note = n-mer motif encoding polynucleotide
  source 1..21: mol_type = other DNA
ccatacttaagaaacatggcg

SEQ ID NO: 3473 - DNA, 21 bp, synthetic construct
  misc_feature 1..21: note = n-mer motif encoding polynucleotide
  source 1..21: mol_type = other DNA
ggcgtgaacacaaaaatcgaa

SEQ ID NO: 3474 - DNA, 21 bp, synthetic construct
  misc_feature 1..21: note = n-mer motif encoding polynucleotide
  source 1..21: mol_type = other DNA
tactcttctgaaatgagcgaa

SEQ ID NO: 3475 - DNA, 21 bp, synthetic construct
  misc_feature 1..21: note = n-mer motif encoding polynucleotide
  source 1..21: mol_type = other DNA
ttagaaaacccaacaccagca

SEQ ID NO: 3476 - DNA, 21 bp, synthetic construct
  misc_feature 1..21: note = n-mer motif encoding polynucleotide
  source 1..21: mol_type = other DNA
ggtgttatgtctaatgctact

SEQ ID NO: 3477 - DNA, 21 bp, synthetic construct
  misc_feature 1..21: note = n-mer motif encoding polynucleotide
  source 1..21: mol_type = other DNA
gcccacactgcattagcgggg

SEQ ID NO: 3478 - DNA, 21 bp, synthetic construct
  misc_feature 1..21: note = n-mer motif encoding polynucleotide
  source 1..21: mol_type = other DNA
cctgttgtgagggatcgttct

SEQ ID NO: 3479 - DNA, 21 bp, synthetic construct
  misc_feature 1..21: note = n-mer motif encoding polynucleotide
  source 1..21: mol_type = other DNA
tctgcgggtatggtgagtctg

SEQ ID NO: 3480 - DNA, 21 bp, synthetic construct
  misc_feature 1..21: note = n-mer motif encoding polynucleotide
  source 1..21: mol_type = other DNA
tcgggtgttaatagtgagcgt

SEQ ID NO: 3481 - DNA, 21 bp, synthetic construct
  misc_feature 1..21: note = n-mer motif encoding polynucleotide
  source 1..21: mol_type = other DNA
aatggggatgttactaatatg

SEQ ID NO: 3482 - DNA, 21 bp, synthetic construct
  misc_feature 1..21: note = n-mer motif encoding polynucleotide
  source 1..21: mol_type = other DNA
tctgttgtgcctacggataag

SEQ ID NO: 3483 - DNA, 21 bp, synthetic construct
  misc_feature 1..21: note = n-mer motif encoding polynucleotide
  source 1..21: mol_type = other DNA
agtaagggtgatcagcttaat

SEQ ID NO: 3484 - DNA, 21 bp, synthetic construct
  misc_feature 1..21: note = n-mer motif encoding polynucleotide
  source 1..21: mol_type = other DNA
gacggagaatcccgattatca

SEQ ID NO: 3485 - DNA, 21 bp, synthetic construct
  misc_feature 1..21: note = n-mer motif encoding polynucleotide
  source 1..21: mol_type = other DNA
ggtaatatgaatcatagtatt

SEQ ID NO: 3486 - DNA, 21 bp, synthetic construct
  misc_feature 1..21: note = n-mer motif encoding polynucleotide
  source 1..21: mol_type = other DNA
agtgggcatgcttctcagggt

SEQ ID NO: 3487 - DNA, 21 bp, synthetic construct
  misc_feature 1..21: note = n-mer motif encoding polynucleotide
  source 1..21: mol_type = other DNA
ggttggagtaataatgagttg

SEQ ID NO: 3488 - DNA, 21 bp, synthetic construct
  misc_feature 1..21: note = n-mer motif encoding polynucleotide
  source 1..21: mol_type = other DNA
ggtgtgcatactcatactgtt

SEQ ID NO: 3489 - DNA, 21 bp, synthetic construct
  misc_feature 1..21: note = n-mer motif encoding polynucleotide
  source 1..21: mol_type = other DNA
cacgtgacagtaacgttaaac

SEQ ID NO: 3490 - DNA, 21 bp, synthetic construct
  misc_feature 1..21: note = n-mer motif encoding polynucleotide
  source 1..21: mol_type = other DNA
acccgtggcaacgacatatca

SEQ ID NO: 3491 - DNA, 21 bp, synthetic construct
  misc_feature 1..21: note = n-mer motif encoding polynucleotide
  source 1..21: mol_type = other DNA
agcaaaggcggcgacatggtt

SEQ ID NO: 3492 - DNA, 21 bp, synthetic construct
  misc_feature 1..21: note = n-mer motif encoding polynucleotide
  source 1..21: mol_type = other DNA
acgcatggtgatcatattcag

SEQ ID NO: 3493 - DNA, 21 bp, synthetic construct
  misc_feature 1..21: note = n-mer motif encoding polynucleotide
  source 1..21: mol_type = other DNA
actacgaattctcatgcgatt

SEQ ID NO: 3494 - DNA, 21 bp, synthetic construct
  misc_feature 1..21: note = n-mer motif encoding polynucleotide
  source 1..21: mol_type = other DNA
gtcagaacagtccttcaacaa

SEQ ID NO: 3495 - DNA, 21 bp, synthetic construct
  misc_feature 1..21: note = n-mer motif encoding polynucleotide
  source 1..21: mol_type = other DNA
actgtgcgttcgcctcagccg

SEQ ID NO: 3496 - DNA, 21 bp, synthetic construct
  misc_feature 1..21: note = n-mer motif encoding polynucleotide
  source 1..21: mol_type = other DNA
aatacttatactgctggtaag

SEQ ID NO: 3497 - DNA, 21 bp, synthetic construct
  misc_feature 1..21: note = n-mer motif encoding polynucleotide
  source 1..21: mol_type = other DNA
attagtaatccggagaatacg

SEQ ID NO: 3498 - DNA, 21 bp, synthetic construct
  misc_feature 1..21: note = n-mer motif encoding polynucleotide
  source 1..21: mol_type = other DNA
atcgggtcgccgttggccaac

SEQ ID NO: 3499 - DNA, 21 bp, synthetic construct
  misc_feature 1..21: note = n-mer motif encoding polynucleotide
  source 1..21: mol_type = other DNA
tatacgggtactcttgttgtt

SEQ ID NO: 3500 - DNA, 21 bp, synthetic construct
  misc_feature 1..21: note = n-mer motif encoding polynucleotide
  source 1..21: mol_type = other DNA
gggcggcacacattagcggac

SEQ ID NO: 3501 - DNA, 21 bp, synthetic construct
  misc_feature 1..21: note = n-mer motif encoding polynucleotide
  source 1..21: mol_type = other DNA
actgatgggccgcgtctggct

SEQ ID NO: 3502 - DNA, 21 bp, synthetic construct
  misc_feature 1..21: note = n-mer motif encoding polynucleotide
  source 1..21: mol_type = other DNA
ggggcaggaaacctgggtacc

SEQ ID NO: 3503 - DNA, 21 bp, synthetic construct
  misc_feature 1..21: note = n-mer motif encoding polynucleotide
  source 1..21: mol_type = other DNA
ctgatgaatcgtaatgctcct

SEQ ID NO: 3504 - DNA, 21 bp, synthetic construct
  misc_feature 1..21: note = n-mer motif encoding polynucleotide
  source 1..21: mol_type = other DNA
aatgctatggcttctagtagg

SEQ ID NO: 3505 - DNA, 21 bp, synthetic construct
  misc_feature 1..21: note = n-mer motif encoding polynucleotide
  source 1..21: mol_type = other DNA
cagcatcgtgcgcaggatgtg

SEQ ID NO: 3506 - DNA, 21 bp, synthetic construct
  misc_feature 1..21: note = n-mer motif encoding polynucleotide
  source 1..21: mol_type = other DNA
aaaatagaaagcggaaccata

SEQ ID NO: 3507 - DNA, 21 bp, synthetic construct
  misc_feature 1..21: note = n-mer motif encoding polynucleotide
  source 1..21: mol_type = other DNA
actaattatcctgaggcgaat

SEQ ID NO: 3508 - DNA, 21 bp, synthetic construct
  misc_feature 1..21: note = n-mer motif encoding polynucleotide
  source 1..21: mol_type = other DNA
gtataccacggggtagccagc

SEQ ID NO: 3509 - DNA, 21 bp, synthetic construct
  misc_feature 1..21: note = n-mer motif encoding polynucleotide
  source 1..21: mol_type = other DNA
tccaacgtccacgtagtaaac

SEQ ID NO: 3510 - DNA, 21 bp, synthetic construct
  misc_feature 1..21: note = n-mer motif encoding polynucleotide
  source 1..21: mol_type = other DNA
acatacaccgacgggaacccc

SEQ ID NO: 3511 - DNA, 21 bp, synthetic construct
  misc_feature 1..21: note = n-mer motif encoding polynucleotide
  source 1..21: mol_type = other DNA
tttattgcgaatacgaatcct

SEQ ID NO: 3512 - DNA, 21 bp, synthetic construct
  misc_feature 1..21: note = n-mer motif encoding polynucleotide
  source 1..21: mol_type = other DNA
gacgccgggtacggccacgac

SEQ ID NO: 3513 - DNA, 21 bp, synthetic construct
  misc_feature 1..21: note = n-mer motif encoding polynucleotide
  source 1..21: mol_type = other DNA
ggtcttagtcggaatgatggt

SEQ ID NO: 3514 - DNA, 21 bp, synthetic construct
  misc_feature 1..21: note = n-mer motif encoding polynucleotide
  source 1..21: mol_type = other DNA
atgatgggcgcgacaacgaaa

SEQ ID NO: 3515 - DNA, 21 bp, synthetic construct
  misc_feature 1..21: note = n-mer motif encoding polynucleotide
  source 1..21: mol_type = other DNA
cccatcaacgtactcacgaca

SEQ ID NO: 3516 - DNA, 21 bp, synthetic construct
  misc_feature 1..21: note = n-mer motif encoding polynucleotide
  source 1..21: mol_type = other DNA
gccgtagaccaatcacgtttg

SEQ ID NO: 3517 - DNA, 21 bp, synthetic construct
  misc_feature 1..21: note = n-mer motif encoding polynucleotide
  source 1..21: mol_type = other DNA
aacgcttctacctacatggac

SEQ ID NO: 3518 - DNA, 21 bp, synthetic construct
  misc_feature 1..21: note = n-mer motif encoding polynucleotide
  source 1..21: mol_type = other DNA
acacaagcaggtcttgcgtca

SEQ ID NO: 3519 - DNA, 21 bp, synthetic construct
  misc_feature 1..21: note = n-mer motif encoding polynucleotide
  source 1..21: mol_type = other DNA
gcacaattcgaatcaggccga

SEQ ID NO: 3520 - DNA, 21 bp, synthetic construct
  misc_feature 1..21: note = n-mer motif encoding polynucleotide
  source 1..21: mol_type = other DNA
cggaatggtggtactacggat

SEQ ID NO: 3521 - DNA, 21 bp, synthetic construct
  misc_feature 1..21: note = n-mer motif encoding polynucleotide
  source 1..21: mol_type = other DNA
gctaatacgtataatgttcag

SEQ ID NO: 3522 - DNA, 21 bp, synthetic construct
  misc_feature 1..21: note = n-mer motif encoding polynucleotide
  source 1..21: mol_type = other DNA
tcgggtgttcatagtgagcgt

SEQ ID NO: 3523 - DNA, 21 bp, synthetic construct
  misc_feature 1..21: note = n-mer motif encoding polynucleotide
  source 1..21: mol_type = other DNA
aacaccggcaccacgagtgtc

SEQ ID NO: 3524 - DNA, 21 bp, synthetic construct
  misc_feature 1..21: note = n-mer motif encoding polynucleotide
  source 1..21: mol_type = other DNA
agtacgagtaatagtcatatg

SEQ ID NO: 3525 - DNA, 21 bp, synthetic construct
  misc_feature 1..21: note = n-mer motif encoding polynucleotide
  source 1..21: mol_type = other DNA
ggtgaacaacacaacgccccc

SEQ ID NO: 3526 - DNA, 21 bp, synthetic construct
  misc_feature 1..21: note = n-mer motif encoding polynucleotide
  source 1..21: mol_type = other DNA
gctcatcatatgacgacggag

SEQ ID NO: 3527 - DNA, 21 bp, synthetic construct
  misc_feature 1..21: note = n-mer motif encoding polynucleotide
  source 1..21: mol_type = other DNA
ttgatgactggtactgcgtcg

SEQ ID NO: 3528 - DNA, 21 bp, synthetic construct
  misc_feature 1..21: note = n-mer motif encoding polynucleotide
  source 1..21: mol_type = other DNA
gctgccggagccgactctcca

SEQ ID NO: 3529 - DNA, 21 bp, synthetic construct
  misc_feature 1..21: note = n-mer motif encoding polynucleotide
  source 1..21: mol_type = other DNA
gtgtctctgagttcgcctccg

SEQ ID NO: 3530 - DNA, 21 bp, synthetic construct
  misc_feature 1..21: note = n-mer motif encoding polynucleotide
  source 1..21: mol_type = other DNA
cgtgttgtagccggtcccaac

SEQ ID NO: 3531 - DNA, 21 bp, synthetic construct
  misc_feature 1..21: note = n-mer motif encoding polynucleotide
  source 1..21: mol_type = other DNA
gataagactgagatgctgcag

SEQ ID NO: 3532 - DNA, 21 bp, synthetic construct
  misc_feature 1..21: note = n-mer motif encoding polynucleotide
  source 1..21: mol_type = other DNA
gcacgagacgacacgatacaa

SEQ ID NO: 3533 - DNA, 21 bp, synthetic construct
  misc_feature 1..21: note = n-mer motif encoding polynucleotide
  source 1..21: mol_type = other DNA
ttacaccttgggttatcatct

SEQ ID NO: 3534 - DNA, 21 bp, synthetic construct
  misc_feature 1..21: note = n-mer motif encoding polynucleotide
  source 1..21: mol_type = other DNA
ctcgaaggacaacgggacgtc

SEQ ID NO: 3535 - DNA, 21 bp, synthetic construct
  misc_feature 1..21: note = n-mer motif encoding polynucleotide
  source 1..21: mol_type = other DNA
gcgtcgttgtcggctccggcg

SEQ ID NO: 3536 - DNA, 21 bp, synthetic construct
  misc_feature 1..21: note = n-mer motif encoding polynucleotide
  source 1..21: mol_type = other DNA
agcaaccctgggaaccacaac

SEQ ID NO: 3537 - DNA, 21 bp, synthetic construct
  misc_feature 1..21: note = n-mer motif encoding polynucleotide
  source 1..21: mol_type = other DNA
gggctgaattctaaggggact

SEQ ID NO: 3538 - DNA, 21 bp, synthetic construct
  misc_feature 1..21: note = n-mer motif encoding polynucleotide
  source 1..21: mol_type = other DNA
aaaacaccctcagcttcagaa

SEQ ID NO: 3539 - DNA, 21 bp, synthetic construct
  misc_feature 1..21: note = n-mer motif encoding polynucleotide
  source 1..21: mol_type = other DNA
gtgctggcgtcgactgagaag

SEQ ID NO: 3540 - DNA, 21 bp, synthetic construct
  misc_feature 1..21: note = n-mer motif encoding polynucleotide
  source 1..21: mol_type = other DNA
tcggtattgaacaaaccaaca

SEQ ID NO: 3541 - DNA, 21 bp, synthetic construct
  misc_feature 1..21: note = n-mer motif encoding polynucleotide
  source 1..21: mol_type = other DNA
cccggtaacggacaaagtccg

SEQ ID NO: 3542 - DNA, 21 bp, synthetic construct
  misc_feature 1..21: note = n-mer motif encoding polynucleotide
  source 1..21: mol_type = other DNA
atcttgatgggcgctaggaca

SEQ ID NO: 3543 - DNA, 21 bp, synthetic construct
  misc_feature 1..21: note = n-mer motif encoding polynucleotide
  source 1..21: mol_type = other DNA
gcactaccatcccactcctcc

SEQ ID NO: 3544 - DNA, 21 bp, synthetic construct
  misc_feature 1..21: note = n-mer motif encoding polynucleotide
  source 1..21: mol_type = other DNA
agggatcagactcatccgaat

SEQ ID NO: 3545 - DNA, 21 bp, synthetic construct
  misc_feature 1..21: note = n-mer motif encoding polynucleotide
  source 1..21: mol_type = other DNA
tctggtccgattcctgctgtt

SEQ ID NO: 3546 - DNA, 21 bp, synthetic construct
  misc_feature 1..21: note = n-mer motif encoding polynucleotide
  source 1..21: mol_type = other DNA
tacgtggacgacaacagtcgc

SEQ ID NO: 3547 - DNA, 21 bp, synthetic construct
  misc_feature 1..21: note = n-mer motif encoding polynucleotide
  source 1..21: mol_type = other DNA
ttgactcggggggtcgccgca

SEQ ID NO: 3548 - DNA, 21 bp, synthetic construct
  misc_feature 1..21: note = n-mer motif encoding polynucleotide
  source 1..21: mol_type = other DNA
tctgagaaggaggctcggctg

SEQ ID NO: 3549 - DNA, 21 bp, synthetic construct
  misc_feature 1..21: note = n-mer motif encoding polynucleotide
  source 1..21: mol_type = other DNA
tccacaacgcctcccttcaaa

SEQ ID NO: 3550 - DNA, 21 bp, synthetic construct
  misc_feature 1..21: note = n-mer motif encoding polynucleotide
  source 1..21: mol_type = other DNA
tactcgacaaccatgcttaac

SEQ ID NO: 3551 - DNA, 21 bp, synthetic construct
  misc_feature 1..21: note = n-mer motif encoding polynucleotide
  source 1..21: mol_type = other DNA
aaaaacggtgttataaacgac

SEQ ID NO: 3552 - DNA, 21 bp, synthetic construct
  misc_feature 1..21: note = n-mer motif encoding polynucleotide
  source 1..21: mol_type = other DNA
ttcggtatagggcacggaaca

SEQ ID NO: 3553 - DNA, 21 bp, synthetic construct
  misc_feature 1..21: note = n-mer motif encoding polynucleotide
  source 1..21: mol_type = other DNA
cctcttcatgttgcttctcct

SEQ ID NO: 3554 - DNA, 21 bp, synthetic construct
  misc_feature 1..21: note = n-mer motif encoding polynucleotide
  source 1..21: mol_type = other DNA
ttgggtaatggtagttctttg

SEQ ID NO: 3555 - DNA, 21 bp, synthetic construct
  misc_feature 1..21: note = n-mer motif encoding polynucleotide
  source 1..21: mol_type = other DNA
agtggcaacgcgaacatagta

SEQ ID NO: 3556 - DNA, 21 bp, synthetic construct
  misc_feature 1..21: note = n-mer motif encoding polynucleotide
  source 1..21: mol_type = other DNA
gggattaatcgtactagtgag

SEQ ID NO: 3557 - DNA, 21 bp, synthetic construct
  misc_feature 1..21: note = n-mer motif encoding polynucleotide
  source 1..21: mol_type = other DNA
tcggataataggaatactgcg

SEQ ID NO: 3558 - DNA, 21 bp, synthetic construct
  misc_feature 1..21: note = n-mer motif encoding polynucleotide
  source 1..21: mol_type = other DNA
cgattaggaaccgtcaccaac

SEQ ID NO: 3559 - DNA, 21 bp, synthetic construct
  misc_feature 1..21: note = n-mer motif encoding polynucleotide
  source 1..21: mol_type = other DNA
gtggagcatgttgctcatcag

SEQ ID NO: 3560 - DNA, 21 bp, synthetic construct
  misc_feature 1..21: note = n-mer motif encoding polynucleotide
  source 1..21: mol_type = other DNA
tatactaagcatcctgttgag

SEQ ID NO: 3561 - DNA, 21 bp, synthetic construct
  misc_feature 1..21: note = n-mer motif encoding polynucleotide
  source 1..21: mol_type = other DNA
tcccgaatcacggtgaacgca

SEQ ID NO: 3562 - DNA, 21 bp, synthetic construct
  misc_feature 1..21: note = n-mer motif encoding polynucleotide
  source 1..21: mol_type = other DNA
acagtatcgtcatacgtacaa

SEQ ID NO: 3563 - DNA, 21 bp, synthetic construct
  misc_feature 1..21: note = n-mer motif encoding polynucleotide
  source 1..21: mol_type = other DNA
cgcgccgaagggagctctggc

SEQ ID NO: 3564 - DNA, 21 bp, synthetic construct
  misc_feature 1..21: note = n-mer motif encoding polynucleotide
  source 1..21: mol_type = other DNA
gctgtggggcggtcggatgat

SEQ ID NO: 3565 - DNA, 21 bp, synthetic construct
  misc_feature 1..21: note = n-mer motif encoding polynucleotide
  source 1..21: mol_type = other DNA
cgcataggcgttggagcacca

SEQ ID NO: 3566 - DNA, 21 bp, synthetic construct
  misc_feature 1..21: note = n-mer motif encoding polynucleotide
  source 1..21: mol_type = other DNA
tactcaaacctcgtactttcc

SEQ ID NO: 3567 - DNA, 21 bp, synthetic construct
  misc_feature 1..21: note = n-mer motif encoding polynucleotide
  source 1..21: mol_type = other DNA
tcgacgaattctgaggcggtt

SEQ ID NO: 3568 - DNA, 21 bp, synthetic construct
  misc_feature 1..21: note = n-mer motif encoding polynucleotide
  source 1..21: mol_type = other DNA
gcaatgtcaacccacatgata

SEQ ID NO: 3569 - DNA, 21 bp, synthetic construct
  misc_feature 1..21: note = n-mer motif encoding polynucleotide
  source 1..21: mol_type = other DNA
agggttgatatttcgcatttt

SEQ ID NO: 3570 - DNA, 21 bp, synthetic construct
  misc_feature 1..21: note = n-mer motif encoding polynucleotide
  source 1..21: mol_type = other DNA
attcttacgcctttggataag

SEQ ID NO: 3571 - DNA, 21 bp, synthetic construct
  misc_feature 1..21: note = n-mer motif encoding polynucleotide
  source 1..21: mol_type = other DNA
gttgcgagtacgacgcagact

SEQ ID NO: 3572 - DNA, 21 bp, synthetic construct
  misc_feature 1..21: note = n-mer motif encoding polynucleotide
  source 1..21: mol_type = other DNA
gaccgtagctccgcgacgctc

SEQ ID NO: 3573 - DNA, 21 bp, synthetic construct
  misc_feature 1..21: note = n-mer motif encoding polynucleotide
  source 1..21: mol_type = other DNA
gatcatagtgagcagaattcg

SEQ ID NO: 3574 - DNA, 21 bp, synthetic construct
  misc_feature 1..21: note = n-mer motif encoding polynucleotide
  source 1..21: mol_type = other DNA
atacgcagcgaattggaagta

SEQ ID NO: 3575 - DNA, 21 bp, synthetic construct
  misc_feature 1..21: note = n-mer motif encoding polynucleotide
  source 1..21: mol_type = other DNA
gcgaatctgggtgatgttgag

SEQ ID NO: 3576 - DNA, 21 bp, synthetic construct
  misc_feature 1..21: note = n-mer motif encoding polynucleotide
  source 1..21: mol_type = other DNA
gagcttaaggagagtcagaag

SEQ ID NO: 3577 - DNA, 21 bp, synthetic construct
  misc_feature 1..21: note = n-mer motif encoding polynucleotide
  source 1..21: mol_type = other DNA
tcatacacagcaggaagaccc

SEQ ID NO: 3578 - DNA, 21 bp, synthetic construct
  misc_feature 1..21: note = n-mer motif encoding polynucleotide
  source 1..21: mol_type = other DNA
ggaccagcctacaaccaaagc

SEQ ID NO: 3579 - DNA, 21 bp, synthetic construct
  misc_feature 1..21: note = n-mer motif encoding polynucleotide
  source 1..21: mol_type = other DNA
catgagagtcattatgttagt

SEQ ID NO: 3580 - DNA, 21 bp, synthetic construct
  misc_feature 1..21: note = n-mer motif encoding polynucleotide
  source 1..21: mol_type = other DNA
aatggtaagctgggtacgact

SEQ ID NO: 3581 - DNA, 21 bp, synthetic construct
  misc_feature 1..21: note = n-mer motif encoding polynucleotide
  source 1..21: mol_type = other DNA
cttccgcctgcgtcggcgggt

SEQ ID NO: 3582 - DNA, 21 bp, synthetic construct
  misc_feature 1..21: note = n-mer motif encoding polynucleotide
  source 1..21: mol_type = other DNA
ttgtcgtatcagactggtcat

SEQ ID NO: 3583 - DNA, 21 bp, synthetic construct
  misc_feature 1..21: note = n-mer motif encoding polynucleotide
  source 1..21: mol_type = other DNA
gacagccaaatcacaagacta

SEQ ID NO: 3584 - DNA, 21 bp, synthetic construct
  misc_feature 1..21: note = n-mer motif encoding polynucleotide
  source 1..21: mol_type = other DNA
aacgtatacgaagggcaccgc

SEQ ID NO: 3585 - DNA, 21 bp, synthetic construct
  misc_feature 1..21: note = n-mer motif encoding polynucleotide
  source 1..21: mol_type = other DNA
ttgtttactgctgggagtact

SEQ ID NO: 3586 - DNA, 21 bp, synthetic construct
  misc_feature 1..21: note = n-mer motif encoding polynucleotide
  source 1..21: mol_type = other DNA
cttgtgaataatgatgggact

SEQ ID NO: 3587 - DNA, 21 bp, synthetic construct
  misc_feature 1..21: note = n-mer motif encoding polynucleotide
  source 1..21: mol_type = other DNA
gcgatgaatgtgcggagtgat

SEQ ID NO: 3588 - DNA, 21 bp, synthetic construct
  misc_feature 1..21: note = n-mer motif encoding polynucleotide
  source 1..21: mol_type = other DNA
gccagccttgaccgccttcca

SEQ ID NO: 3589 - DNA, 21 bp, synthetic construct
  misc_feature 1..21: note = n-mer motif encoding polynucleotide
  source 1..21: mol_type = other DNA
ggctctcggaacggacccaca

SEQ ID NO: 3590 - DNA, 21 bp, synthetic construct
  misc_feature 1..21: note = n-mer motif encoding polynucleotide
  source 1..21: mol_type = other DNA
atgagtgatgggcattcgaag

SEQ ID NO: 3591 - DNA, 21 bp, synthetic construct
  misc_feature 1..21: note = n-mer motif encoding polynucleotide
  source 1..21: mol_type = other DNA
tctaaccgtacggaaatgcca

SEQ ID NO: 3592 - DNA, 21 bp, synthetic construct
  misc_feature 1..21: note = n-mer motif encoding polynucleotide
  source 1..21: mol_type = other DNA
aacgtggtgaaaaacaacaca

SEQ ID NO: 3593 - DNA, 21 bp, synthetic construct
  misc_feature 1..21: note = n-mer motif encoding polynucleotide
  source 1..21: mol_type = other DNA
gtggtcgactcaacatacccg

SEQ ID NO: 3594 - DNA, 21 bp, synthetic construct
  misc_feature 1..21: note = n-mer motif encoding polynucleotide
  source 1..21: mol_type = other DNA
gtggctggggggacttcggag

SEQ ID NO: 3595 - DNA, 21 bp, synthetic construct
  misc_feature 1..21: note = n-mer motif encoding polynucleotide
  source 1..21: mol_type = other DNA
cgggcagacatgactccctta

SEQ ID NO: 3596 - DNA, 21 bp, synthetic construct
  misc_feature 1..21: note = n-mer motif encoding polynucleotide
  source 1..21: mol_type = other DNA
ggacacgaacaaactgacgca

SEQ ID NO: 3597 - DNA, 21 bp, synthetic construct
  misc_feature 1..21: note = n-mer motif encoding polynucleotide
  source 1..21: mol_type = other DNA
agtgctttgattagtgtggtt

SEQ ID NO: 3598 - DNA, 21 bp, synthetic construct
  misc_feature 1..21: note = n-mer motif encoding polynucleotide
  source 1..21: mol_type = other DNA
aactcgacaacggcacaatca

SEQ ID NO: 3599 - DNA, 21 bp, synthetic construct
  misc_feature 1..21: note = n-mer motif encoding polynucleotide
  source 1..21: mol_type = other DNA
tacggcgacctaactacagtc

SEQ ID NO: 3600 - DNA, 21 bp, synthetic construct
  misc_feature 1..21: note = n-mer motif encoding polynucleotide
  source 1..21: mol_type = other DNA
gcacgcaacgacggacaagga

SEQ ID NO: 3601 - DNA, 21 bp, synthetic construct
  misc_feature 1..21: note = n-mer motif encoding polynucleotide
  source 1..21: mol_type = other DNA
ctgaacgttagttcatccaaa

SEQ ID NO: 3602 - DNA, 21 bp, synthetic construct
  misc_feature 1..21: note = n-mer motif encoding polynucleotide
  source 1..21: mol_type = other DNA
tctggcgtctcgaaagaacgg

SEQ ID NO: 3603 - DNA, 21 bp, synthetic construct
  misc_feature 1..21: note = n-mer motif encoding polynucleotide
  source 1..21: mol_type = other DNA
aacatggaacacaccatggcg

SEQ ID NO: 3604 - DNA, 21 bp, synthetic construct
  misc_feature 1..21: note = n-mer motif encoding polynucleotide
  source 1..21: mol_type = other DNA
gctcgtccggcttcgtctgat

SEQ ID NO: 3605 - DNA, 21 bp, synthetic construct
  misc_feature 1..21: note = n-mer motif encoding polynucleotide
  source 1..21: mol_type = other DNA
cttagggaagaatctgcacgt

SEQ ID NO: 3606 - DNA, 21 bp, synthetic construct
  misc_feature 1..21: note = n-mer motif encoding polynucleotide
  source 1..21: mol_type = other DNA
ttggccaacatgtccgcacca

SEQ ID NO: 3607 - DNA, 21 bp, synthetic construct
  misc_feature 1..21: note = n-mer motif encoding polynucleotide
  source 1..21: mol_type = other DNA
aaccacacggtagaaggacgc

SEQ ID NO: 3608 - DNA, 21 bp, synthetic construct
  misc_feature 1..21: note = n-mer motif encoding polynucleotide
  source 1..21: mol_type = other DNA
cctcagcatcagcatgagcat

SEQ ID NO: 3609 - DNA, 21 bp, synthetic construct
  misc_feature 1..21: note = n-mer motif encoding polynucleotide
  source 1..21: mol_type = other DNA
aattcttcggagctgaagacg

SEQ ID NO: 3610 - DNA, 21 bp, synthetic construct
  misc_feature 1..21: note = n-mer motif encoding polynucleotide
  source 1..21: mol_type = other DNA
cttgttgctgagcgtttgccg

SEQ ID NO: 3611 - DNA, 21 bp, synthetic construct
  misc_feature 1..21: note = n-mer motif encoding polynucleotide
  source 1..21: mol_type = other DNA
aacgttatgcactcttcctcc

SEQ ID NO: 3612 - DNA, 21 bp, synthetic construct
  misc_feature 1..21: note = n-mer motif encoding polynucleotide
  source 1..21: mol_type = other DNA
gcgagtgataagggggcgaat

SEQ ID NO: 3613 - DNA, 21 bp, synthetic construct
  misc_feature 1..21: note = n-mer motif encoding polynucleotide
  source 1..21: mol_type = other DNA
agtctggatcggaagcctccg

SEQ ID NO: 3614 - DNA, 21 bp, synthetic construct
  misc_feature 1..21: note = n-mer motif encoding polynucleotide
  source 1..21: mol_type = other DNA
acagaacacgaaaaatccact

SEQ ID NO: 3615 - DNA, 21 bp, synthetic construct
  misc_feature 1..21: note = n-mer motif encoding polynucleotide
  source 1..21: mol_type = other DNA
cctcataatcaggagatgggt

SEQ ID NO: 3616 - DNA, 21 bp, synthetic construct
  misc_feature 1..21: note = n-mer motif encoding polynucleotide
  source 1..21: mol_type = other DNA
gagtctaagactgtggttatt

SEQ ID NO: 3617 - DNA, 21 bp, synthetic construct
  misc_feature 1..21: note = n-mer motif encoding polynucleotide
  source 1..21: mol_type = other DNA
tcgacgggccaaaacttaaaa

SEQ ID NO: 3618 - DNA, 21 bp, synthetic construct
  misc_feature 1..21: note = n-mer motif encoding polynucleotide
  source 1..21: mol_type = other DNA
gttcttcatgtttctgatgtt

SEQ ID NO: 3619 - DNA, 21 bp, synthetic construct
  misc_feature 1..21: note = n-mer motif encoding polynucleotide
  source 1..21: mol_type = other DNA
cctgacgcagcgcgtagcccg

SEQ ID NO: 3620 - DNA, 21 bp, synthetic construct
  misc_feature 1..21: note = n-mer motif encoding polynucleotide
  source 1..21: mol_type = other DNA
gctcctcggcatgctcatcct

SEQ ID NO: 3621 - DNA, 21 bp, synthetic construct
  misc_feature 1..21: note = n-mer motif encoding polynucleotide
  source 1..21: mol_type = other DNA
catgtgaatcctacgccggcg

SEQ ID NO: 3622 - DNA, 21 bp, synthetic construct
  misc_feature 1..21: note = n-mer motif encoding polynucleotide
  source 1..21: mol_type = other DNA
ttgcctaatgagcgtccgggt

SEQ ID NO: 3623 - DNA, 21 bp, synthetic construct
  misc_feature 1..21: note = n-mer motif encoding polynucleotide
  source 1..21: mol_type = other DNA
gaggctaagggttttggtcat

SEQ ID NO: 3624 - DNA, 21 bp, synthetic construct
  misc_feature 1..21: note = n-mer motif encoding polynucleotide
  source 1..21: mol_type = other DNA
tcagaaaacacctctgtaccc

SEQ ID NO: 3625 - DNA, 21 bp, synthetic construct
  misc_feature 1..21: note = n-mer motif encoding polynucleotide
  source 1..21: mol_type = other DNA
ggtcccggagaaaactaccga

SEQ ID NO: 3626 - DNA, 21 bp, synthetic construct
  misc_feature 1..21: note = n-mer motif encoding polynucleotide
  source 1..21: mol_type = other DNA
tctcatgagatgaataatggt

SEQ ID NO: 3627 - DNA, 21 bp, synthetic construct
  misc_feature 1..21: note = n-mer motif encoding polynucleotide
  source 1..21: mol_type = other DNA
gtagacacctacagcggtctg

SEQ ID NO: 3628 - DNA, 21 bp, synthetic construct
  misc_feature 1..21: note = n-mer motif encoding polynucleotide
  source 1..21: mol_type = other DNA
ggagtcctaggaaacatggta

SEQ ID NO: 3629 - DNA, 21 bp, synthetic construct
  misc_feature 1..21: note = n-mer motif encoding polynucleotide
  source 1..21: mol_type = other DNA
gcgctggataatagtagtcgg

SEQ ID NO: 3630 - DNA, 21 bp, synthetic construct
  misc_feature 1..21: note = n-mer motif encoding polynucleotide
  source 1..21: mol_type = other DNA
tttctgggttctagtaatcat

SEQ ID NO: 3631 - DNA, 21 bp, synthetic construct
  misc_feature 1..21: note = n-mer motif encoding polynucleotide
  source 1..21: mol_type = other DNA
cctgtggttcatggtgagcct

SEQ ID NO: 3632 - DNA, 21 bp, synthetic construct
  misc_feature 1..21: note = n-mer motif encoding polynucleotide
  source 1..21: mol_type = other DNA
cgcagggaaggtatcctaatg

SEQ ID NO: 3633 - DNA, 21 bp, synthetic construct
  misc_feature 1..21: note = n-mer motif encoding polynucleotide
  source 1..21: mol_type = other DNA
cagcagggggcgcctacttct

SEQ ID NO: 3634 - DNA, 21 bp, synthetic construct
  misc_feature 1..21: note = n-mer motif encoding polynucleotide
  source 1..21: mol_type = other DNA
aaggttagtggtggggagacg

SEQ ID NO: 3635 - DNA, 21 bp, synthetic construct
  misc_feature 1..21: note = n-mer motif encoding polynucleotide
  source 1..21: mol_type = other DNA
gcgaaacacgaaagctcgtct

SEQ ID NO: 3636 - DNA, 21 bp, synthetic construct
  misc_feature 1..21: note = n-mer motif encoding polynucleotide
  source 1..21: mol_type = other DNA
attcttatgggtgcgcgtact

SEQ ID NO: 3637 - DNA, 21 bp, synthetic construct
  misc_feature 1..21: note = n-mer motif encoding polynucleotide
  source 1..21: mol_type = other DNA
acgctaggcagcagcagcacc

SEQ ID NO: 3638 - DNA, 21 bp, synthetic construct
  misc_feature 1..21: note = n-mer motif encoding polynucleotide
  source 1..21: mol_type = other DNA
ctaagatctgaaccgacacaa

SEQ ID NO: 3639 - DNA, 21 bp, synthetic construct
  misc_feature 1..21: note = n-mer motif encoding polynucleotide
  source 1..21: mol_type = other DNA
cgctcggaacaaaaaactccg

SEQ ID NO: 3640 - DNA, 21 bp, synthetic construct
  misc_feature 1..21: note = n-mer motif encoding polynucleotide
  source 1..21: mol_type = other DNA
cacgctccaagcggcgccata

SEQ ID NO: 3641 - DNA, 21 bp, synthetic construct
  misc_feature 1..21: note = n-mer motif encoding polynucleotide
  source 1..21: mol_type = other DNA
agtagtgttacttcgagggag

SEQ ID NO: 3642 - DNA, 21 bp, synthetic construct
  misc_feature 1..21: note = n-mer motif encoding polynucleotide
  source 1..21: mol_type = other DNA
gtgaatccgcatcctgcgcag

SEQ ID NO: 3643 - DNA, 21 bp, synthetic construct
  misc_feature 1..21: note = n-mer motif encoding polynucleotide
  source 1..21: mol_type = other DNA
caatactcgatggacacgcgc

SEQ ID NO: 3644 - DNA, 21 bp, synthetic construct
  misc_feature 1..21: note = n-mer motif encoding polynucleotide
  source 1..21: mol_type = other DNA
actcctggtgttactaggacg

SEQ ID NO: 3645 - DNA, 21 bp, synthetic construct
  misc_feature 1..21: note = n-mer motif encoding polynucleotide
  source 1..21: mol_type = other DNA
ctttatgaggttggtactcct

SEQ ID NO: 3646 - DNA, 21 bp, synthetic construct
  misc_feature 1..21: note = n-mer motif encoding polynucleotide
  source 1..21: mol_type = other DNA
acgatgacgagtgagctttcg

SEQ ID NO: 3647 - DNA, 21 bp, synthetic construct
  misc_feature 1..21: note = n-mer motif encoding polynucleotide
  source 1..21: mol_type = other DNA
tcaggttcggaataccgtacc

SEQ ID NO: 3648 - DNA, 21 bp, synthetic construct
  misc_feature 1..21: note = n-mer motif encoding polynucleotide
  source 1..21: mol_type = other DNA
gaaatgcaaaccaaaaacgcc

SEQ ID NO: 3649 - DNA, 21 bp, synthetic construct
  misc_feature 1..21: note = n-mer motif encoding polynucleotide
  source 1..21: mol_type = other DNA
ggccacgaaaacatgggcgtg

SEQ ID NO: 3650 - DNA, 21 bp, synthetic construct
  misc_feature 1..21: note = n-mer motif encoding polynucleotide
  source 1..21: mol_type = other DNA
ggggcgcatacgtcggcttcg

SEQ ID NO: 3651 - DNA, 21 bp, synthetic construct
  misc_feature 1..21: note = n-mer motif encoding polynucleotide
  source 1..21: mol_type = other DNA
gctgatacgctgctgcgtagg

SEQ ID NO: 3652 - DNA, 21 bp, synthetic construct
  misc_feature 1..21: note = n-mer motif encoding polynucleotide
  source 1..21: mol_type = other DNA
gacaacagcaacaacgtccca

SEQ ID NO: 3653 - DNA, 21 bp, synthetic construct
  misc_feature 1..21: note = n-mer motif encoding polynucleotide
  source 1..21: mol_type = other DNA
atgactgctaacttggtggaa

SEQ ID NO: 3654 - DNA, 21 bp, synthetic construct
  misc_feature 1..21: note = n-mer motif encoding polynucleotide
  source 1..21: mol_type = other DNA
gaagcgggacgcacgcttcaa

SEQ ID NO: 3655 - DNA, 21 bp, synthetic construct
  misc_feature 1..21: note = n-mer motif encoding polynucleotide
  source 1..21: mol_type = other DNA
agacacgtcgtccccgactcc

SEQ ID NO: 3656 - DNA, 21 bp, synthetic construct
  misc_feature 1..21: note = n-mer motif encoding polynucleotide
  source 1..21: mol_type = other DNA
gtgagttctgagcagtatagg

SEQ ID NO: 3657 - DNA, 21 bp, synthetic construct
  misc_feature 1..21: note = n-mer motif encoding polynucleotide
  source 1..21: mol_type = other DNA
ggtatcgaagcaagtcgcgga

SEQ ID NO: 3658 - DNA, 21 bp, synthetic construct
  misc_feature 1..21: note = n-mer motif encoding polynucleotide
  source 1..21: mol_type = other DNA
agacaaggcgtgaacggagta

SEQ ID NO: 3659 - DNA, 21 bp, synthetic construct
  misc_feature 1..21: note = n-mer motif encoding polynucleotide
  source 1..21: mol_type = other DNA
actgtgatgatgagtacgagg

SEQ ID NO: 3660 - DNA, 21 bp, synthetic construct
  misc_feature 1..21: note = n-mer motif encoding polynucleotide
  source 1..21: mol_type = other DNA
tggcaagaccacaacaaagtc

SEQ ID NO: 3661 - DNA, 21 bp, synthetic construct
  misc_feature 1..21: note = n-mer motif encoding polynucleotide
  source 1..21: mol_type = other DNA
ggaatcacaggatcaacagga

SEQ ID NO: 3662 - DNA, 21 bp, synthetic construct
  misc_feature 1..21: note = n-mer motif encoding polynucleotide
  source 1..21: mol_type = other DNA
aattatgctcagagggatggt

SEQ ID NO: 3663 - DNA, 21 bp, synthetic construct
  misc_feature 1..21: note = n-mer motif encoding polynucleotide
  source 1..21: mol_type = other DNA
aaacaagaagctctgtcctca

SEQ ID NO: 3664 - DNA, 21 bp, synthetic construct
  misc_feature 1..21: note = n-mer motif encoding polynucleotide
  source 1..21: mol_type = other DNA
tcaactttagaccgaagcgaa

SEQ ID NO: 3665 - DNA, 21 bp, synthetic construct
  misc_feature 1..21: note = n-mer motif encoding polynucleotide
  source 1..21: mol_type = other DNA
gcgattacgaatacgcagcag

SEQ ID NO: 3666 - DNA, 21 bp, synthetic construct
  misc_feature 1..21: note = n-mer motif encoding polynucleotide
  source 1..21: mol_type = other DNA
aggctggcgactcagagtgct

SEQ ID NO: 3667 - DNA, 21 bp, synthetic construct
  misc_feature 1..21: note = n-mer motif encoding polynucleotide
  source 1..21: mol_type = other DNA
tggcagcttacgacgagtcat

SEQ ID NO: 3668 - DNA, 21 bp, synthetic construct
  misc_feature 1..21: note = n-mer motif encoding polynucleotide
  source 1..21: mol_type = other DNA
ggtggtagtggttctaatact

SEQ ID NO: 3669 - DNA, 21 bp, synthetic construct
  misc_feature 1..21: note = n-mer motif encoding polynucleotide
  source 1..21: mol_type = other DNA
aacttagtagcgtacacgaaa

SEQ ID NO: 3670 - DNA, 21 bp, synthetic construct
  misc_feature 1..21: note = n-mer motif encoding polynucleotide
  source 1..21: mol_type = other DNA
aaggcttcgcatgatactagt

SEQ ID NO: 3671 - DNA, 21 bp, synthetic construct
  misc_feature 1..21: note = n-mer motif encoding polynucleotide
  source 1..21: mol_type = other DNA
gccataacgataataggcact

SEQ ID NO: 3672 - DNA, 21 bp, synthetic construct
  misc_feature 1..21: note = n-mer motif encoding polynucleotide
  source 1..21: mol_type = other DNA
aacgcatcgtcggaccgcttc

SEQ ID NO: 3673 - DNA, 21 bp, synthetic construct
  misc_feature 1..21: note = n-mer motif encoding polynucleotide
  source 1..21: mol_type = other DNA
gaaacgcaacgtatcgaactg

SEQ ID NO: 3674 - DNA, 21 bp, synthetic construct
  misc_feature 1..21: note = n-mer motif encoding polynucleotide
  source 1..21: mol_type = other DNA
gtgattgaggttaattcgcgt

SEQ ID NO: 3675 - DNA, 21 bp, synthetic construct
  misc_feature 1..21: note = n-mer motif encoding polynucleotide
  source 1..21: mol_type = other DNA
gatagggatatggagggtgtt

SEQ ID NO: 3676 - DNA, 21 bp, synthetic construct
  misc_feature 1..21: note = n-mer motif encoding polynucleotide
  source 1..21: mol_type = other DNA
atttcggagatgacgcggtat

SEQ ID NO: 3677 - DNA, 21 bp, synthetic construct
  misc_feature 1..21: note = n-mer motif encoding polynucleotide
  source 1..21: mol_type = other DNA
gagcatgatgtgagtacgcgt

SEQ ID NO: 3678 - DNA, 21 bp, synthetic construct
  misc_feature 1..21: note = n-mer motif encoding polynucleotide
  source 1..21: mol_type = other DNA
cgtatggaggagactgcttat

SEQ ID NO: 3679 - DNA, 21 bp, synthetic construct
  misc_feature 1..21: note = n-mer motif encoding polynucleotide
  source 1..21: mol_type = other DNA
tatagtactgatcttaggatg

SEQ ID NO: 3680 - DNA, 21 bp, synthetic construct
  misc_feature 1..21: note = n-mer motif encoding polynucleotide
  source 1..21: mol_type = other DNA
gtgcctgagcctaagaaggcg

SEQ ID NO: 3681 - DNA, 21 bp, synthetic construct
  misc_feature 1..21: note = n-mer motif encoding polynucleotide
  source 1..21: mol_type = other DNA
acttatgcgcctaggtcgcct

SEQ ID NO: 3682 - DNA, 21 bp, synthetic construct
  misc_feature 1..21: note = n-mer motif encoding polynucleotide
  source 1..21: mol_type = other DNA
gctgcggcttcgcctttggct

SEQ ID NO: 3683 - DNA, 21 bp, synthetic construct
  misc_feature 1..21: note = n-mer motif encoding polynucleotide
  source 1..21: mol_type = other DNA
agtgggacgtatgctagtcgt

SEQ ID NO: 3684 - DNA, 21 bp, synthetic construct
  misc_feature 1..21: note = n-mer motif encoding polynucleotide
  source 1..21: mol_type = other DNA
actgaagcatcaatcgcggcg

SEQ ID NO: 3685 - DNA, 21 bp, synthetic construct
  misc_feature 1..21: note = n-mer motif encoding polynucleotide
  source 1..21: mol_type = other DNA
cgcatcgtagacacgttggga

SEQ ID NO: 3686 - DNA, 21 bp, synthetic construct
  misc_feature 1..21: note = n-mer motif encoding polynucleotide
  source 1..21: mol_type = other DNA
tatctgcaggagaagtttcct

SEQ ID NO: 3687 - DNA, 21 bp, synthetic construct
  misc_feature 1..21: note = n-mer motif encoding polynucleotide
  source 1..21: mol_type = other DNA
gttcatgatcagggggctggg

SEQ ID NO: 3688 - DNA, 21 bp, synthetic construct
  misc_feature 1..21: note = n-mer motif encoding polynucleotide
  source 1..21: mol_type = other DNA
ccccaagccactctcaacaac

SEQ ID NO: 3689 - DNA, 21 bp, synthetic construct
  misc_feature 1..21: note = n-mer motif encoding polynucleotide
  source 1..21: mol_type = other DNA
tgcggaatgtccgaatgctcg

SEQ ID NO: 3690 - DNA, 21 bp, synthetic construct
  misc_feature 1..21: note = n-mer motif encoding polynucleotide
  source 1..21: mol_type = other DNA
ggttcgcacaacgggccgaca

SEQ ID NO: 3691 - DNA, 21 bp, synthetic construct
  misc_feature 1..21: note = n-mer motif encoding polynucleotide
  source 1..21: mol_type = other DNA
tttgggtctgggccgaatctt

SEQ ID NO: 3692 - DNA, 21 bp, synthetic construct
  misc_feature 1..21: note = n-mer motif encoding polynucleotide
  source 1..21: mol_type = other DNA
atggatacgaatacgcatcgt

SEQ ID NO: 3693 - DNA, 21 bp, synthetic construct
  misc_feature 1..21: note = n-mer motif encoding polynucleotide
  source 1..21: mol_type = other DNA
aagaataatcctgaggatggt

SEQ ID NO: 3694 - DNA, 21 bp, synthetic construct
  misc_feature 1..21: note = n-mer motif encoding polynucleotide
  source 1..21: mol_type = other DNA
ctgcctacggctactggtcag

SEQ ID NO: 3695 - DNA, 21 bp, synthetic construct
  misc_feature 1..21: note = n-mer motif encoding polynucleotide
  source 1..21: mol_type = other DNA
acggctgagcgtactgagtat

SEQ ID NO: 3696 - DNA, 21 bp, synthetic construct
  misc_feature 1..21: note = n-mer motif encoding polynucleotide
  source 1..21: mol_type = other DNA
aactacagggacatcacaatg

SEQ ID NO: 3697 - DNA, 21 bp, synthetic construct
  misc_feature 1..21: note = n-mer motif encoding polynucleotide
  source 1..21: mol_type = other DNA
cccgcgagaagcgacgccctt

SEQ ID NO: 3698 - DNA, 21 bp, synthetic construct
  misc_feature 1..21: note = n-mer motif encoding polynucleotide
  source 1..21: mol_type = other DNA
tccgttgtaactcttggggtg

SEQ ID NO: 3699 - DNA, 21 bp, synthetic construct
  misc_feature 1..21: note = n-mer motif encoding polynucleotide
  source 1..21: mol_type = other DNA
gttgttaaggagattaagctg

SEQ ID NO: 3700 - DNA, 21 bp, synthetic construct
  misc_feature 1..21: note = n-mer motif encoding polynucleotide
  source 1..21: mol_type = other DNA
gaccactcgaaacaaaactct

SEQ ID NO: 3701 - DNA, 21 bp, synthetic construct
  misc_feature 1..21: note = n-mer motif encoding polynucleotide
  source 1..21: mol_type = other DNA
cagtctaatttggttattaat

SEQ ID NO: 3702 - DNA, 21 bp, synthetic construct
  misc_feature 1..21: note = n-mer motif encoding polynucleotide
  source 1..21: mol_type = other DNA
attccggttggggcgatggct

SEQ ID NO: 3703 - DNA, 21 bp, synthetic construct
  misc_feature 1..21: note = n-mer motif encoding polynucleotide
  source 1..21: mol_type = other DNA
acgtcggagatgcgtactgct

SEQ ID NO: 3704 - DNA, 21 bp, synthetic construct
  misc_feature 1..21: note = n-mer motif encoding polynucleotide
  source 1..21: mol_type = other DNA
ggtagtcagcgtgctatgaat

SEQ ID NO: 3705 - DNA, 21 bp, synthetic construct
  misc_feature 1..21: note = n-mer motif encoding polynucleotide
  source 1..21: mol_type = other DNA
cacctgtcacaagcaaaccac

SEQ ID NO: 3706 - DNA, 21 bp, synthetic construct
  misc_feature 1..21: note = n-mer motif encoding polynucleotide
  source 1..21: mol_type = other DNA
ggagggaactcccacggggta

SEQ ID NO: 3707 - DNA, 21 bp, synthetic construct
  misc_feature 1..21: note = n-mer motif encoding polynucleotide
  source 1..21: mol_type = other DNA
gtgactcgtagtacgaaggag

SEQ ID NO: 3708 - DNA, 21 bp, synthetic construct
  misc_feature 1..21: note = n-mer motif encoding polynucleotide
  source 1..21: mol_type = other DNA
atgctcagagcaagcaccgcc

SEQ ID NO: 3709 - DNA, 21 bp, synthetic construct
  misc_feature 1..21: note = n-mer motif encoding polynucleotide
  source 1..21: mol_type = other DNA
ggcaggcaaataccagaacaa

SEQ ID NO: 3710 - DNA, 21 bp, synthetic construct
  misc_feature 1..21: note = n-mer motif encoding polynucleotide
  source 1..21: mol_type = other DNA
tggaatcagaatgtgtctcat

SEQ ID NO: 3711 - DNA, 21 bp, synthetic construct
  misc_feature 1..21: note = n-mer motif encoding polynucleotide
  source 1..21: mol_type = other DNA
cagcggggggagcttcctgcg

SEQ ID NO: 3712 - DNA, 21 bp, synthetic construct
  misc_feature 1..21: note = n-mer motif encoding polynucleotide
  source 1..21: mol_type = other DNA
gcgaatgatagtttgcgttct

SEQ ID NO: 3713 - DNA, 21 bp, synthetic construct
  misc_feature 1..21: note = n-mer motif encoding polynucleotide
  source 1..21: mol_type = other DNA
aacatgccaccggaatcgcac

SEQ ID NO: 3714 - DNA, 21 bp, synthetic construct
  misc_feature 1..21: note = n-mer motif encoding polynucleotide
  source 1..21: mol_type = other DNA
aatttgagtcttcagagtctg

SEQ ID NO: 3715 - DNA, 21 bp, synthetic construct
  misc_feature 1..21: note = n-mer motif encoding polynucleotide
  source 1..21: mol_type = other DNA
acatcagacggtctactaagt

SEQ ID NO: 3716 - DNA, 21 bp, synthetic construct
  misc_feature 1..21: note = n-mer motif encoding polynucleotide
  source 1..21: mol_type = other DNA
gcgggccaagcgtaccaatcc

SEQ ID NO: 3717 - DNA, 21 bp, synthetic construct
  misc_feature 1..21: note = n-mer motif encoding polynucleotide
  source 1..21: mol_type = other DNA
ctgagtgtgaaggaggagatt

SEQ ID NO: 3718 - DNA, 21 bp, synthetic construct
  misc_feature 1..21: note = n-mer motif encoding polynucleotide
  source 1..21: mol_type = other DNA
gataatagtcctgctaatcat

SEQ ID NO: 3719 - DNA, 21 bp, synthetic construct
  misc_feature 1..21: note = n-mer motif encoding polynucleotide
  source 1..21: mol_type = other DNA
atgcacaacctaccctcatac

SEQ ID NO: 3720 - DNA, 21 bp, synthetic construct
  misc_feature 1..21: note = n-mer motif encoding polynucleotide
  source 1..21: mol_type = other DNA
taccaagcctcaaacaacagt

SEQ ID NO: 3721 - DNA, 21 bp, synthetic construct
  misc_feature 1..21: note = n-mer motif encoding polynucleotide
  source 1..21: mol_type = other DNA
gcgcgggcagaaggggtcttc

SEQ ID NO: 3722 - DNA, 21 bp, synthetic construct
  misc_feature 1..21: note = n-mer motif encoding polynucleotide
  source 1..21: mol_type = other DNA
ggccgagaaggaaacctacca

SEQ ID NO: 3723 - DNA, 21 bp, synthetic construct
  misc_feature 1..21: note = n-mer motif encoding polynucleotide
  source 1..21: mol_type = other DNA
caagctgcagaaagggacaga

SEQ ID NO: 3724 - DNA, 21 bp, synthetic construct
  misc_feature 1..21: note = n-mer motif encoding polynucleotide
  source 1..21: mol_type = other DNA
gttgagaataatcgtatgagt

SEQ ID NO: 3725 - DNA, 21 bp, synthetic construct
  misc_feature 1..21: note = n-mer motif encoding polynucleotide
  source 1..21: mol_type = other DNA
aatatgtcgcatagtactctg

SEQ ID NO: 3726 - DNA, 21 bp, synthetic construct
  misc_feature 1..21: note = n-mer motif encoding polynucleotide
  source 1..21: mol_type = other DNA
tcttcgttgggtcttgctccg

SEQ ID NO: 3727 - DNA, 21 bp, synthetic construct
  misc_feature 1..21: note = n-mer motif encoding polynucleotide
  source 1..21: mol_type = other DNA
aacgtcgctccctacagtagc

SEQ ID NO: 3728 - DNA, 21 bp, synthetic construct
  misc_feature 1..21: note = n-mer motif encoding polynucleotide
  source 1..21: mol_type = other DNA
aggcctgcgcagctgcctgag

SEQ ID NO: 3729 - DNA, 21 bp, synthetic construct
  misc_feature 1..21: note = n-mer motif encoding polynucleotide
  source 1..21: mol_type = other DNA
atgtcgggttctgggaacgca

SEQ ID NO: 3730 - DNA, 21 bp, synthetic construct
  misc_feature 1..21: note = n-mer motif encoding polynucleotide
  source 1..21: mol_type = other DNA
cacgggggggaacaccggaac

SEQ ID NO: 3731 - DNA, 21 bp, synthetic construct
  misc_feature 1..21: note = n-mer motif encoding polynucleotide
  source 1..21: mol_type = other DNA
gcatccggcgcacgctacgtc

SEQ ID NO: 3732 - DNA, 21 bp, synthetic construct
  misc_feature 1..21: note = n-mer motif encoding polynucleotide
  source 1..21: mol_type = other DNA
caaaaccacgcgtctggtgaa

SEQ ID NO: 3733 - DNA, 21 bp, synthetic construct
  misc_feature 1..21: note = n-mer motif encoding polynucleotide
  source 1..21: mol_type = other DNA
gcacaccaaaaagacctacgc

SEQ ID NO: 3734 - DNA, 21 bp, synthetic construct
  misc_feature 1..21: note = n-mer motif encoding polynucleotide
  source 1..21: mol_type = other DNA
tttgggaaggttggtactgct

SEQ ID NO: 3735 - DNA, 21 bp, synthetic construct
  misc_feature 1..21: note = n-mer motif encoding polynucleotide
  source 1..21: mol_type = other DNA
ctgcagaagtcgactctggct

SEQ ID NO: 3736 - DNA, 21 bp, synthetic construct
  misc_feature 1..21: note = n-mer motif encoding polynucleotide
  source 1..21: mol_type = other DNA
attcataatgagtcttatggt

SEQ ID NO: 3737 - protein, 7 aa, synthetic construct
  REGION 1..7: note = n-mer motif
RGDLTTP

SEQ ID NO: 3738 - protein, 7 aa, synthetic construct
  REGION 1..7: note = n-mer motif
RGDLNQY

SEQ ID NO: 3739 - protein, 7 aa, synthetic construct
  REGION 1..7: note = n-mer motif
RGDLSTP

SEQ ID NO: 3740 - protein, 7 aa, synthetic construct
  REGION 1..7: note = n-mer motif
RGDQLYH

SEQ ID NO: 3741 - protein, 7 aa, synthetic construct
  REGION 1..7: note = n-mer motif
RGDTMSK

SEQ ID NO: 3742 - protein, 7 aa, synthetic construct
  REGION 1..7: note = n-mer motif
RGDATEL

SEQ ID NO: 3743 - protein, 7 aa, synthetic construct
  REGION 1..7: note = n-mer motif
RGDLSTP

SEQ ID NO: 3744 - protein, 7 aa, synthetic construct
  REGION 1..7: note = n-mer motif
RGDMINT

SEQ ID NO: 3745 - protein, 7 aa, synthetic construct
  REGION 1..7: note = n-mer motif
RGDLNQY

SEQ ID NO: 3746 - protein, 7 aa, synthetic construct
  REGION 1..7: note = n-mer motif
RGDTMSK

SEQ ID NO: 3747 - protein, 7 aa, synthetic construct
  REGION 1..7: note = n-mer motif
RGDLTTP

SEQ ID NO: 3748 - protein, 7 aa, synthetic construct
  REGION 1..7: note = n-mer motif
RGDLNDS

SEQ ID NO: 3749 - protein, 7 aa, synthetic construct
  REGION 1..7: note = n-mer motif
ANPNILD

SEQ ID NO: 3750 - protein, 7 aa, synthetic construct
  REGION 1..7: note = n-mer motif
RGDTMNY

SEQ ID NO: 3751 - protein, 7 aa, synthetic construct
  REGION 1..7: note = n-mer motif
MSNLGYE

SEQ ID NO: 3752 - protein, 7 aa, synthetic construct
  REGION 1..7: note = n-mer motif
YTSQTST

SEQ ID NO: 3753 - protein, 7 aa, synthetic construct
  REGION 1..7: note = n-mer motif
LGGNSRF

SEQ ID NO: 3754 - protein, 7 aa, synthetic construct
  REGION 1..7: note = n-mer motif
QSQAIQL

SEQ ID NO: 3755 - protein, 7 aa, synthetic construct
  REGION 1..7: note = n-mer motif
NTYTPGK

SEQ ID NO: 3756 - protein, 7 aa, synthetic construct
  REGION 1..7: note = n-mer motif
GAEAGRQ

SEQ ID NO: 3757 - protein, 7 aa, synthetic construct
  REGION 1..7: note = n-mer motif
EHATAKQ

SEQ ID NO: 3758 - protein, 7 aa, synthetic construct
  REGION 1..7: note = n-mer motif
AAQLVSP

SEQ ID NO: 3759 - protein, 7 aa, synthetic construct
  REGION 1..7: note = n-mer motif
DQTASIV

SEQ ID NO: 3760 - protein, 7 aa, synthetic construct
  REGION 1..7: note = n-mer motif
VQTHIGV

SEQ ID NO: 3761 - protein, 7 aa, synthetic construct
  REGION 1..7: note = n-mer motif
SYGNTHD

SEQ ID NO: 3762 - protein, 7 aa, synthetic construct
  REGION 1..7: note = n-mer motif
TSTASKQ

SEQ ID NO: 3763 - protein, 7 aa, synthetic construct
  REGION 1..7: note = n-mer motif
LVTHERI

SEQ ID NO: 3764 - protein, 7 aa, synthetic construct
  REGION 1..7: note = n-mer motif
MDKSNNS

SEQ ID NO: 3765 - protein, 7 aa, synthetic construct
  REGION 1..7: note = n-mer motif
RGDMSRE

SEQ ID NO: 3766 - protein, 7 aa, synthetic construct
  REGION 1..7: note = n-mer motif
RGDVAEI

SEQ ID NO: 3767 - protein, 7 aa, synthetic construct
  REGION 1..7: note = n-mer motif
GGENRTP

SEQ ID NO: 3768 - protein, 7 aa, synthetic construct
  REGION 1..7: note = n-mer motif
AGHQQLA

SEQ ID NO: 3769 - protein, 7 aa, synthetic construct
  REGION 1..7: note = n-mer motif
RLNSSMN

SEQ ID NO: 3770 - protein, 7 aa, synthetic construct
  REGION 1..7: note = n-mer motif
YYEKLSA

SEQ ID NO: 3771 - protein, 7 aa, synthetic construct
  REGION 1..7: note = n-mer motif
EASNYER

SEQ ID NO: 3772 - protein, 7 aa, synthetic construct
  REGION 1..7: note = n-mer motif
FQTDTHR

SEQ ID NO: 3773 - protein, 7 aa, synthetic construct
  REGION 1..7: note = n-mer motif
NSSQWPN

SEQ ID NO: 3774 - protein, 7 aa, synthetic construct
  REGION 1..7: note = n-mer motif
DGKTTSN

SEQ ID NO: 3775 - protein, 7 aa, synthetic construct
  REGION 1..7: note = n-mer motif
AVHATSS

SEQ ID NO: 3776 - protein, 7 aa, synthetic construct
  REGION 1..7: note = n-mer motif
KTLPGRE

SEQ ID NO: 3777 - protein, 7 aa, synthetic construct
  REGION 1..7: note = n-mer motif
ILKSDAP

SEQ ID NO: 3778 - protein, 7 aa, synthetic construct
  REGION 1..7: note = n-mer motif
STNEAPK

SEQ ID NO: 3779 - protein, 7 aa, synthetic construct
  REGION 1..7: note = n-mer motif
FDSANGR

SEQ ID NO: 3780 - protein, 7 aa, synthetic construct
  REGION 1..7: note = n-mer motif
MDAAYGS

SEQ ID NO: 3781 - protein, 7 aa, synthetic construct
  REGION 1..7: note = n-mer motif
NKDHNHL

SEQ ID NO: 3782 - protein, 7 aa, synthetic construct
  REGION 1..7: note = n-mer motif
GQYSQTL

SEQ ID NO: 3783 - protein, 7 aa, synthetic construct
  REGION 1..7: note = n-mer motif
EAFPRAG

SEQ ID NO: 3784 - protein, 7 aa, synthetic construct
  REGION 1..7: note = n-mer motif
EHTHLNP

SEQ ID NO: 3785 - protein, 7 aa, synthetic construct
  REGION 1..7: note = n-mer motif
MQREDAN

SEQ ID NO: 3786 - protein, 7 aa, synthetic construct
  REGION 1..7: note = n-mer motif
LTGSDMK

SEQ ID NO: 3787 - protein, 7 aa, synthetic construct
  REGION 1..7: note = n-mer motif
RVNNDAI

SEQ ID NO: 3788 - protein, 7 aa, synthetic construct
  REGION 1..7: note = n-mer motif
RGDQGTH

SEQ ID NO: 3789 - protein, 7 aa, synthetic construct
  REGION 1..7: note = n-mer motif
INISSDF

SEQ ID NO: 3790 - protein, 7 aa, synthetic construct
  REGION 1..7: note = n-mer motif
NNDNGFV

SEQ ID NO: 3791 - protein, 7 aa, synthetic construct
  REGION 1..7: note = n-mer motif
FIANTNP

SEQ ID NO: 3792 - protein, 7 aa, synthetic construct
  REGION 1..7: note = n-mer motif
GLHGTNA

SEQ ID NO: 3793 - protein, 7 aa, synthetic construct
  REGION 1..7: note = n-mer motif
KTIDIAQ

SEQ ID NO: 3794 - protein, 7 aa, synthetic construct
  REGION 1..7: note = n-mer motif
SSDSRIP

SEQ ID NO: 3795 - protein, 7 aa, synthetic construct
  REGION 1..7: note = n-mer motif
STSPVNS

SEQ ID NO: 3796 - protein, 7 aa, synthetic construct
  REGION 1..7: note = n-mer motif
ASMPSVD

SEQ ID NO: 3797 - protein, 7 aa, synthetic construct
  REGION 1..7: note = n-mer motif
GHNMAQA

SEQ ID NO: 3798 - protein, 7 aa, synthetic construct
  REGION 1..7: note = n-mer motif
HNKPNGD

SEQ ID NO: 3799 - protein, 7 aa, synthetic construct
  REGION 1..7: note = n-mer motif
YRMETNP

SEQ ID NO: 3800 - protein, 7 aa, synthetic construct
  REGION 1..7: note = n-mer motif
LGNVVHP

SEQ ID NO: 3801 - protein, 7 aa, synthetic construct
  REGION 1..7: note = n-mer motif
VTAHQLS

SEQ ID NO: 3802 - protein, 7 aa, synthetic construct
  REGION 1..7: note = n-mer motif
TMVEVLP

SEQ ID NO: 3803 - protein, 7 aa, synthetic construct
  REGION 1..7: note = n-mer motif
IKGSGSQ

SEQ ID NO: 3804 - protein, 7 aa, synthetic construct
  REGION 1..7: note = n-mer motif
TNGGSLN

SEQ ID NO: 3805 - protein, 7 aa, synthetic construct
  REGION 1..7: note = n-mer motif
LGGNSRI

SEQ ID NO: 3806 - protein, 7 aa, synthetic construct
  REGION 1..7: note = n-mer motif
RGDAANK

SEQ ID NO: 3807 - protein, 7 aa, synthetic construct
  REGION 1..7: note = n-mer motif
ALNAQGI

SEQ ID NO: 3808 - protein, 7 aa, synthetic construct
  REGION 1..7: note = n-mer motif
AEHATSS

SEQ ID NO: 3809 - protein, 7 aa, synthetic construct
  REGION 1..7: note = n-mer motif
YLTTGTA

SEQ ID NO: 3810 - protein, 7 aa, synthetic construct
  REGION 1..7: note = n-mer motif
AEAQTRV

SEQ ID NO: 3811 - protein, 7 aa, synthetic construct
  REGION 1..7: note = n-mer motif
AEQGLSS

SEQ ID NO: 3812 - protein, 7 aa, synthetic construct
  REGION 1..7: note = n-mer motif
LIVTQHV

SEQ ID NO: 3813 - protein, 7 aa, synthetic construct
  REGION 1..7: note = n-mer motif
SSYQSGL

SEQ ID NO: 3814 - protein, 7 aa, synthetic construct
  REGION 1..7: note = n-mer motif
ATVYNEL

SEQ ID NO: 3815 - protein, 7 aa, synthetic construct
  REGION 1..7: note = n-mer motif
HDTVGER

SEQ ID NO: 3816 - protein, 7 aa, synthetic construct
  REGION 1..7: note = n-mer motif
RGDLNDS

SEQ ID NO: 3817 - protein, 7 aa, synthetic construct
  REGION 1..7: note = n-mer motif
HDISLDR

SEQ ID NO: 3818 - protein, 7 aa, synthetic construct
  REGION 1..7: note = n-mer motif
TEQSYSR

SEQ ID NO: 3819 - protein, 6 aa, synthetic construct
  REGION 1..6: note = n-mer motif
WGAEFA

SEQ ID NO: 3820 - protein, 7 aa, synthetic construct
  REGION 1..7: note = n-mer motif
AVHATSR

SEQ ID NO: 3821 - protein, 7 aa, synthetic construct
  REGION 1..7: note = n-mer motif
IESKTVQ

SEQ ID NO: 3822 - protein, 7 aa, synthetic construct
  REGION 1..7: note = n-mer motif
TNVSTLL

SEQ ID NO: 3823 - protein, 7 aa, synthetic construct
  REGION 1..7: note = n-mer motif
PPNGSSR

SEQ ID NO: 3824 - protein, 7 aa, synthetic construct
  REGION 1..7: note = n-mer motif
PSTHGYV

SEQ ID NO: 3825 - protein, 7 aa, synthetic construct
  REGION 1..7: note = n-mer motif
TAASTAR

SEQ ID NO: 3826 - protein, 7 aa, synthetic construct
  REGION 1..7: note = n-mer motif
YNAGGEQ

SEQ ID NO: 3827 - protein, 7 aa, synthetic construct
  REGION 1..7: note = n-mer motif
THNQREL

SEQ ID NO: 3828 - protein, 7 aa, synthetic construct
  REGION 1..7: note = n-mer motif
TFTVDGR

SEQ ID NO: 3829 - protein, 7 aa, synthetic construct
  REGION 1..7: note = n-mer motif
HSSPGSS

SEQ ID NO: 3830 - protein, 7 aa, synthetic construct
  REGION 1..7: note = n-mer motif
STSGYNT

SEQ ID NO: 3831 - protein, 7 aa, synthetic construct
  REGION 1..7: note = n-mer motif
SEKLTDK

SEQ ID NO: 3832 - protein, 7 aa, synthetic construct
  REGION 1..7: note = n-mer motif
GRNTSNL

SEQ ID NO: 3833 - protein, 7 aa, synthetic construct
  REGION 1..7: note = n-mer motif
TGTAISR

SEQ ID NO: 3834 - protein, 7 aa, synthetic construct
  REGION 1..7: note = n-mer motif
SMQDPSL

SEQ ID NO: 3835 - protein, 7 aa, synthetic construct
  REGION 1..7: note = n-mer motif
TRSDIGV

SEQ ID NO: 3836 - protein, 7 aa, synthetic construct
  REGION 1..7: note = n-mer motif
TQNHQLS

SEQ ID NO: 3837 - protein, 7 aa, synthetic construct
  REGION 1..7: note = n-mer motif
FVDNRQP

SEQ ID NO: 3838 - protein, 7 aa, synthetic construct
  REGION 1..7: note = n-mer motif
SLNSSST

SEQ ID NO: 3839 - protein, 7 aa, synthetic construct
  REGION 1..7: note = n-mer motif
KAVSEII

SEQ ID NO: 3840 - protein, 7 aa, synthetic construct
  REGION 1..7: note = n-mer motif
GTSDNYR

SEQ ID NO: 3841 - protein, 7 aa, synthetic construct
  REGION 1..7: note = n-mer motif
MSSHTVQ

SEQ ID NO: 3842 - protein, 7 aa, synthetic construct
  REGION 1..7: note = n-mer motif
SITHSNT

SEQ ID NO: 3843 - protein, 7 aa, synthetic construct
  REGION 1..7: note = n-mer motif
VQTSTGA

SEQ ID NO: 3844 - protein, 7 aa, synthetic construct
  REGION 1..7: note = n-mer motif
RGDMTRA

SEQ ID NO: 3845 - protein, 7 aa, synthetic construct
  REGION 1..7: note = n-mer motif
IGLQNST

SEQ ID NO: 3846 - protein, 7 aa, synthetic construct
  REGION 1..7: note = n-mer motif
SADRDNK

SEQ ID NO: 3847 - protein, 7 aa, synthetic construct
  REGION 1..7: note = n-mer motif
YSQSIKN

SEQ ID NO: 3848 - protein, 7 aa, synthetic construct
  REGION 1..7: note = n-mer motif
RSLDSGM

SEQ ID NO: 3849 - protein, 7 aa, synthetic construct
  REGION 1..7: note = n-mer motif
AVPQSLP

SEQ ID NO: 3850 - protein, 7 aa, synthetic construct
  REGION 1..7: note = n-mer motif
ANDSIKL

SEQ ID NO: 3851 - protein, 7 aa, synthetic construct
  REGION 1..7: note = n-mer motif
NGNIYPS

SEQ ID NO: 3852 - protein, 7 aa, synthetic construct
  REGION 1..7: note = n-mer motif
GQTNAVH

SEQ ID NO: 3853 - protein, 7 aa, synthetic construct
  REGION 1..7: note = n-mer motif
QGDLRGS

SEQ ID NO: 3854 - protein, 7 aa, synthetic construct
  REGION 1..7: note = n-mer motif
VKASAGV

SEQ ID NO: 3855 - protein, 7 aa, synthetic construct
  REGION 1..7: note = n-mer motif
IASTWNM

SEQ ID NO: 3856 - protein, 7 aa, synthetic construct
  REGION 1..7: note = n-mer motif
NSAESSR

SEQ ID NO: 3857 - protein, 7 aa, synthetic construct
  REGION 1..7: note = n-mer motif
VFTGQTE

SEQ ID NO: 3858 - protein, 7 aa, synthetic construct
  REGION 1..7: note = n-mer motif
FGTSYTT

SEQ ID NO: 3859 - protein, 7 aa, synthetic construct
  REGION 1..7: note = n-mer motif
AVNETRL

SEQ ID NO: 3860 - protein, 7 aa, synthetic construct
  REGION 1..7: note = n-mer motif
GRTDTPN

SEQ ID NO: 3861 - protein, 7 aa, synthetic construct
  REGION 1..7: note = n-mer motif
NDRPLAS

SEQ ID NO: 3862 - protein, 7 aa, synthetic construct
  REGION 1..7: note = n-mer motif
AYQLTPA

SEQ ID NO: 3863 - protein, 7 aa, synthetic construct
  REGION 1..7: note = n-mer motif
MGEMGNI

SEQ ID NO: 3864 - protein, 7 aa, synthetic construct
  REGION 1..7: note = n-mer motif
ADMQHTV

SEQ ID NO: 3865 - protein, 7 aa, synthetic construct
  REGION 1..7: note = n-mer motif
AVVLNSN

SEQ ID NO: 3866 - protein, 7 aa, synthetic construct
  REGION 1..7: note = n-mer motif
FRDGQGM

SEQ ID NO: 3867 - protein, 7 aa, synthetic construct
  REGION 1..7: note = n-mer motif
KSTSNIE

SEQ ID NO: 3868 - protein, 7 aa, synthetic construct
  REGION 1..7: note = n-mer motif
TQAFSLG

SEQ ID NO: 3869 - protein, 7 aa, synthetic construct
  REGION 1..7: note = n-mer motif
WSRTGNT

SEQ ID NO: 3870 - protein, 7 aa, synthetic construct
  REGION 1..7: note = n-mer motif
STNTEPR

SEQ ID NO: 3871 - protein, 7 aa, synthetic construct
  REGION 1..7: note = n-mer motif
ENSDLSY

SEQ ID NO: 3872 - protein, 7 aa, synthetic construct
  REGION 1..7: note = n-mer motif
IDERSSI

SEQ ID NO: 3873 - protein, 7 aa, synthetic construct
  REGION 1..7: note = n-mer motif
DVHSSIP

SEQ ID NO: 3874 - protein, 7 aa, synthetic construct
  REGION 1..7: note = n-mer motif
ISGSTTH

SEQ ID NO: 3875 - protein, 7 aa, synthetic construct
  REGION 1..7: note = n-mer motif
WQTQVTT

SEQ ID NO: 3876 - protein, 7 aa, synthetic construct
  REGION 1..7: note = n-mer motif
NMGPMGR

SEQ ID NO: 3877 - protein, 7 aa, synthetic construct
  REGION 1..7: note = n-mer motif
VTQSSTL

SEQ ID NO: 3878 - protein, 7 aa, synthetic construct
  REGION 1..7: note = n-mer motif
IDRSASL

SEQ ID NO: 3879 - protein, 7 aa, synthetic construct
  REGION 1..7: note = n-mer motif
SHSITGL

SEQ ID NO: 3880 - protein, 7 aa, synthetic construct
  REGION 1..7: note = n-mer motif
KAGQLVE

SEQ ID NO: 3881 - protein, 7 aa, synthetic construct
  REGION 1..7: note = n-mer motif
SGVSEGN

SEQ ID NO: 3882 - protein, 7 aa, synthetic construct
  REGION 1..7: note = n-mer motif
TLTLSTL

SEQ ID NO: 3883 - protein, 7 aa, synthetic construct
  REGION 1..7: note = n-mer motif
AHNKHES

SEQ ID NO: 3884 - protein, 7 aa, synthetic construct
  REGION 1..7: note = n-mer motif
HNNNLQN

SEQ ID NO: 3885 - protein, 7 aa, synthetic construct
  REGION 1..7: note = n-mer motif
YNESSNA

SEQ ID NO: 3886 - protein, 7 aa, synthetic construct
  REGION 1..7: note = n-mer motif
REQAAER

SEQ ID NO: 3887 - protein, 7 aa, synthetic construct
  REGION 1..7: note = n-mer motif
TQYGTLP

SEQ ID NO: 3888 - protein, 7 aa, synthetic construct
  REGION 1..7: note = n-mer motif
HPGNSSV

SEQ ID NO: 3889 - protein, 7 aa, synthetic construct
  REGION 1..7: note = n-mer motif
SSREVSP

SEQ ID NO: 3890 - protein, 7 aa, synthetic construct
  REGION 1..7: note = n-mer motif
ANSTSQW

SEQ ID NO: 3891 - protein, 7 aa, synthetic construct
  REGION 1..7: note = n-mer motif
RDMINSS

SEQ ID NO: 3892 - protein, 7 aa, synthetic construct
  REGION 1..7: note = n-mer motif
ALPSGAR

SEQ ID NO: 3893 - protein, 7 aa, synthetic construct
  REGION 1..7: note = n-mer motif
PGTSGSR

SEQ ID NO: 3894 - protein, 7 aa, synthetic construct
  REGION 1..7: note = n-mer motif
WNGNATQ

SEQ ID NO: 3895 - protein, 7 aa, synthetic construct
  REGION 1..7: note = n-mer motif
GKATLVL

SEQ ID NO: 3896 - protein, 7 aa, synthetic construct
  REGION 1..7: note = n-mer motif
YTNGGHL

SEQ ID NO: 3897 - protein, 7 aa, synthetic construct
  REGION 1..7: note = n-mer motif
SQYNGTQ

SEQ ID NO: 3898 - protein, 7 aa, synthetic construct
  REGION 1..7: note = n-mer motif
YSSESAY

SEQ ID NO: 3899 - protein, 7 aa, synthetic construct
  REGION 1..7: note = n-mer motif
VKAGVAD

SEQ ID NO: 3900 - protein, 7 aa, synthetic construct
  REGION 1..7: note = n-mer motif
TMGTVQI

SEQ ID NO: 3901 - protein, 7 aa, synthetic construct
  REGION 1..7: note = n-mer motif
GVAGAVV

SEQ ID NO: 3902 - protein, 7 aa, synthetic construct
  REGION 1..7: note = n-mer motif
YDKTLSV

SEQ ID NO: 3903 - protein, 7 aa, synthetic construct
  REGION 1..7: note = n-mer motif
HGSAYSQ

SEQ ID NO: 3904 - protein, 7 aa, synthetic construct
  REGION 1..7: note = n-mer motif
TANIMSK

SEQ ID NO: 3905 - protein, 7 aa, synthetic construct
  REGION 1..7: note = n-mer motif
FSRETLA

SEQ ID NO: 3906 - protein, 7 aa, synthetic construct
  REGION 1..7: note = n-mer motif
LSGAGSQ

SEQ ID NO: 3907 - protein, 7 aa, synthetic construct
  REGION 1..7: note = n-mer motif
SNANQMS

SEQ ID NO: 3908 - protein, 7 aa, synthetic construct
  REGION 1..7: note = n-mer motif
SVLSPSN

SEQ ID NO: 3909 - protein, 7 aa, synthetic construct
  REGION 1..7: note = n-mer motif
DNVHGQV

SEQ ID NO: 3910 - protein, 7 aa, synthetic construct
  REGION 1..7: note = n-mer motif
DGREYAS

SEQ ID NO: 3911 - protein, 7 aa, synthetic construct
  REGION 1..7: note = n-mer motif
ISNQIKM

SEQ ID NO: 3912 - protein, 7 aa, synthetic construct
  REGION 1..7: note = n-mer motif
GRDNQHV

SEQ ID NO: 3913 - protein, 7 aa, synthetic construct
  REGION 1..7: note = n-mer motif
RNHETGA

SEQ ID NO: 3914 - protein, 7 aa, synthetic construct
  REGION 1..7: note = n-mer motif
SGSGANI

SEQ ID NO: 3915 - protein, 7 aa, synthetic construct
  REGION 1..7: note = n-mer motif
SMSDGLR

SEQ ID NO: 3916 - protein, 7 aa, synthetic construct
  REGION 1..7: note = n-mer motif
KESSAME

SEQ ID NO: 3917 - protein, 7 aa, synthetic construct
  REGION 1..7: note = n-mer motif
ANASTSL

SEQ ID NO: 3918 - protein, 7 aa, synthetic construct
  REGION 1..7: note = n-mer motif
SASGYLV

SEQ ID NO: 3919 - protein, 7 aa, synthetic construct
  REGION 1..7: note = n-mer motif
DTTQKPH

SEQ ID NO: 3920 - protein, 7 aa, synthetic construct
  REGION 1..7: note = n-mer motif
LIRGSME

SEQ ID NO: 3921 - protein, 7 aa, synthetic construct
  REGION 1..7: note = n-mer motif
DRTYSNT

SEQ ID NO: 3922 - protein, 7 aa, synthetic construct
  REGION 1..7: note = n-mer motif
ALGHQGN

SEQ ID NO: 3923 - protein, 7 aa, synthetic construct
  REGION 1..7: note = n-mer motif
ANHTSQE

SEQ ID NO: 3924 - protein, 7 aa, synthetic construct
  REGION 1..7: note = n-mer motif
ERGLNTN

SEQ ID NO: 3925 - protein, 7 aa, synthetic construct
  REGION 1..7: note = n-mer motif
TVGGNHH

SEQ ID NO: 3926 - protein, 7 aa, synthetic construct
  REGION 1..7: note = n-mer motif
PSDRTTY

SEQ ID NO: 3927 - protein, 7 aa, synthetic construct
  REGION 1..7: note = n-mer motif
SRQENFS

SEQ ID NO: 3928 - protein, 7 aa, synthetic construct
  REGION 1..7: note = n-mer motif
NKTTMEF

SEQ ID NO: 3929 - protein, 7 aa, synthetic construct
  REGION 1..7: note = n-mer motif
KHTENGT

SEQ ID NO: 3930 - protein, 7 aa, synthetic construct
  REGION 1..7: note = n-mer motif
ETGAMTS

SEQ ID NO: 3931 - protein, 7 aa, synthetic construct
  REGION 1..7: note = n-mer motif
GHRDSGG

SEQ ID NO: 3932 - protein, 7 aa, synthetic construct
  REGION 1..7: note = n-mer motif
RNAEGGL

SEQ ID NO: 3933 - protein, 7 aa, synthetic construct
  REGION 1..7: note = n-mer motif
GQRTTND

SEQ ID NO: 3934 - protein, 7 aa, synthetic construct
  REGION 1..7: note = n-mer motif
YNDALRP

SEQ ID NO: 3935 - protein, 7 aa, synthetic construct
  REGION 1..7: note = n-mer motif
GYATTVQ

SEQ ID NO: 3936 - protein, 7 aa, synthetic construct
  REGION 1..7: note = n-mer motif
IGGGIGN

SEQ ID NO: 3937 - protein, 7 aa, synthetic construct
  REGION 1..7: note = n-mer motif
VAVSNTP

SEQ ID NO: 3938 - protein, 7 aa, synthetic construct
  REGION 1..7: note = n-mer motif
LANGMTA

SEQ ID NO: 3939 - protein, 7 aa, synthetic construct
  REGION 1..7: note = n-mer motif
ISGSSSL

SEQ ID NO: 3940 - protein, 7 aa, synthetic construct
  REGION 1..7: note = n-mer motif
SNVHVVN

SEQ ID NO: 3941 - protein, 7 aa, synthetic construct
  REGION 1..7: note = n-mer motif
VETSRLY

SEQ ID NO: 3942 - protein, 7 aa, synthetic construct
  REGION 1..7: note = n-mer motif
SNADILA

SEQ ID NO: 3943 - protein, 7 aa, synthetic construct
  REGION 1..7: note = n-mer motif
NNVNPYS

SEQ ID NO: 3944 - protein, 7 aa, synthetic construct
  REGION 1..7: note = n-mer motif
ISVGVSV

SEQ ID NO: 3945 - protein, 7 aa, synthetic construct
  REGION 1..7: note = n-mer motif
SANNIAP

SEQ ID NO: 3946 - protein, 7 aa, synthetic construct
  REGION 1..7: note = n-mer motif
GVQMTAG

SEQ ID NO: 3947 - protein, 7 aa, synthetic construct
  REGION 1..7: note = n-mer motif
RYIANQT

SEQ ID NO: 3948 - protein, 7 aa, synthetic construct
  REGION 1..7: note = n-mer motif
TTESLHL

SEQ ID NO: 3949 - protein, 7 aa, synthetic construct
  REGION 1..7: note = n-mer motif
GYQDKTR

SEQ ID NO: 3950 - protein, 7 aa, synthetic construct
  REGION 1..7: note = n-mer motif
ASRPAAQ

SEQ ID NO: 3951 - protein, 7 aa, synthetic construct
  REGION 1..7: note = n-mer motif
SIQELLR

SEQ ID NO: 3952 - protein, 7 aa, synthetic construct
  REGION 1..7: note = n-mer motif
TVRSPQQ

SEQ ID NO: 3953 - protein, 7 aa, synthetic construct
  REGION 1..7: note = n-mer motif
AVLGGSN

SEQ ID NO: 3954 - protein, 7 aa, synthetic construct
  REGION 1..7: note = n-mer motif
MSTVLRE

SEQ ID NO: 3955 - protein, 7 aa, synthetic construct
  REGION 1..7: note = n-mer motif
TYGITHD

SEQ ID NO: 3956 - protein, 7 aa, synthetic construct
  REGION 1..7: note = n-mer motif
DANAGTR

SEQ ID NO: 3957 - protein, 7 aa, synthetic construct
  REGION 1..7: note = n-mer motif
FNGYVMA

SEQ ID NO: 3958 - protein, 7 aa, synthetic construct
  REGION 1..7: note = n-mer motif
INNFNTL

SEQ ID NO: 3959 - protein, 7 aa, synthetic construct
  REGION 1..7: note = n-mer motif
VANERLP

SEQ ID NO: 3960 - protein, 7 aa, synthetic construct
  REGION 1..7: note = n-mer motif
TNSNQGS

SEQ ID NO: 3961 - protein, 7 aa, synthetic construct
  REGION 1..7: note = n-mer motif
ATLNNSY

SEQ ID NO: 3962 - protein, 7 aa, synthetic construct
  REGION 1..7: note = n-mer motif
KNAQIDL

SEQ ID NO: 3963 - protein, 7 aa, synthetic construct
  REGION 1..7: note = n-mer motif
PATLHLT

SEQ ID NO: 3964 - protein, 7 aa, synthetic construct
  REGION 1..7: note = n-mer motif
LGSSTVS

SEQ ID NO: 3965 - protein, 7 aa, synthetic construct
  REGION 1..7: note = n-mer motif
NWNSEGT

SEQ ID NO: 3966 - protein, 7 aa, synthetic construct
  REGION 1..7: note = n-mer motif
PTNNLSM

SEQ ID NO: 3967 - protein, 7 aa, synthetic construct
  REGION 1..7: note = n-mer motif
ALKPNST

SEQ ID NO: 3968 - protein, 7 aa, synthetic construct
  REGION 1..7: note = n-mer motif
MVNSENT

SEQ ID NO: 3969 - protein, 7 aa, synthetic construct
  REGION 1..7: note = n-mer motif
SMDARLT

SEQ ID NO: 3970 - protein, 7 aa, synthetic construct
  REGION 1..7: note = n-mer motif
NNVVRDD

SEQ ID NO: 3971 - protein, 7 aa, synthetic construct
  REGION 1..7: note = n-mer motif
TRDQRST

SEQ ID NO: 3972 - protein, 7 aa, synthetic construct
  REGION 1..7: note = n-mer motif
ADIRNDK

SEQ ID NO: 3973 - protein, 7 aa, synthetic construct
  REGION 1..7: note = n-mer motif
MRDKINP

SEQ ID NO: 3974 - protein, 7 aa, synthetic construct
  REGION 1..7: note = n-mer motif
PTPNEHM

SEQ ID NO: 3975 - protein, 7 aa, synthetic construct
  REGION 1..7: note = n-mer motif
GYSHNSD

SEQ ID NO: 3976 - protein, 7 aa, synthetic construct
  REGION 1..7: note = n-mer motif
LRDGIAS

SEQ ID NO: 3977 - protein, 7 aa, synthetic construct
  REGION 1..7: note = n-mer motif
MNQMGGL

SEQ ID NO: 3978 - protein, 7 aa, synthetic construct
  REGION 1..7: note = n-mer motif
SSPTKGT

SEQ ID NO: 3979 - protein, 7 aa, synthetic construct
  REGION 1..7: note = n-mer motif
YLDNPLT

SEQ ID NO: 3980 - protein, 7 aa, synthetic construct
  REGION 1..7: note = n-mer motif
VMQRSAQ

SEQ ID NO: 3981 - protein, 7 aa, synthetic construct
  REGION 1..7: note = n-mer motif
SLQLTAG

SEQ ID NO: 3982 - protein, 7 aa, synthetic construct
  REGION 1..7: note = n-mer motif
VGSGGYN

SEQ ID NO: 3983 - protein, 7 aa, synthetic construct
  REGION 1..7: note = n-mer motif
DRPNNVS

SEQ ID NO: 3984 - protein, 7 aa, synthetic construct
  REGION 1..7: note = n-mer motif
LTEKASI

SEQ ID NO: 3985 - protein, 7 aa, synthetic construct
  REGION 1..7: note = n-mer motif
TTKTTSM

SEQ ID NO: 3986 - protein, 7 aa, synthetic construct
  REGION 1..7: note = n-mer motif
RLDLQVH

SEQ ID NO: 3987 - protein, 7 aa, synthetic construct
  REGION 1..7: note = n-mer motif
THVIGAV

SEQ ID NO: 3988 - protein, 7 aa, synthetic construct
  REGION 1..7: note = n-mer motif
TLTHLNP

SEQ ID NO: 3989 - protein, 7 aa, synthetic construct
  REGION 1..7: note = n-mer motif
TSISSQS

SEQ ID NO: 3990 - protein, 7 aa, synthetic construct
  REGION 1..7: note = n-mer motif
YHTHQVA

SEQ ID NO: 3991 - protein, 7 aa, synthetic construct
  REGION 1..7: note = n-mer motif
MQGLNNM

SEQ ID NO: 3992 - protein, 7 aa, synthetic construct
  REGION 1..7: note = n-mer motif
GSASNSG

SEQ ID NO: 3993 - protein, 7 aa, synthetic construct
  REGION 1..7: note = n-mer motif
ANTTGQV

SEQ ID NO: 3994 - protein, 7 aa, synthetic construct
  REGION 1..7: note = n-mer motif
SVVNTNI

SEQ ID NO: 3995 - protein, 7 aa, synthetic construct
  REGION 1..7: note = n-mer motif
SNNLNQE

SEQ ID NO: 3996 - protein, 7 aa, synthetic construct
  REGION 1..7: note = n-mer motif
MNGSGMQ

SEQ ID NO: 3997 - protein, 7 aa, synthetic construct
  REGION 1..7: note = n-mer motif
ISHDLKY

SEQ ID NO: 3998 - protein, 7 aa, synthetic construct
  REGION 1..7: note = n-mer motif
TVNADGS

SEQ ID NO: 3999 - protein, 7 aa, synthetic construct
  REGION 1..7: note = n-mer motif
NHIRNPM

SEQ ID NO: 4000 - protein, 7 aa, synthetic construct
  REGION 1..7: note = n-mer motif
STRVTLD

SEQ ID NO: 4001 - protein, 7 aa, synthetic construct
  REGION 1..7: note = n-mer motif
AMGALVH

SEQ ID NO: 4002 - protein, 7 aa, synthetic construct
  REGION 1..7: note = n-mer motif
AQAMSNS

SEQ ID NO: 4003 - protein, 7 aa, synthetic construct
  REGION 1..7: note = n-mer motif
NANGMNT

SEQ ID NO: 4004 - protein, 7 aa, synthetic construct
  REGION 1..7: note = n-mer motif
LTLPSAN

SEQ ID NO: 4005 - protein, 7 aa, synthetic construct
  REGION 1..7: note = n-mer motif
YQTGDKD

SEQ ID NO: 4006 - protein, 7 aa, synthetic construct
  REGION 1..7: note = n-mer motif
RREENVN

SEQ ID NO: 4007 - protein, 7 aa, synthetic construct
  REGION 1..7: note = n-mer motif
GTTTAVA

SEQ ID NO: 4008 - protein, 7 aa, synthetic construct
  REGION 1..7: note = n-mer motif
TAGGERA

SEQ ID NO: 4009 - protein, 7 aa, synthetic construct
  REGION 1..7: note = n-mer motif
AGNEPRP

SEQ ID NO: 4010 - protein, 7 aa, synthetic construct
  REGION 1..7: note = n-mer motif
ANNTANS

SEQ ID NO: 4011 - protein, 7 aa, synthetic construct
  REGION 1..7: note = n-mer motif
HVNSRDL

SEQ ID NO: 4012 - protein, 7 aa, synthetic construct
  REGION 1..7: note = n-mer motif
TYQLSGN

SEQ ID NO: 4013 - protein, 7 aa, synthetic construct
  REGION 1..7: note = n-mer motif
RGDSMAR

SEQ ID NO: 4014 - protein, 7 aa, synthetic construct
  REGION 1..7: note = n-mer motif
LNNSATV

SEQ ID NO: 4015 - protein, 7 aa, synthetic construct
  REGION 1..7: note = n-mer motif
LHANNER

SEQ ID NO: 4016 - protein, 7 aa, synthetic construct
  REGION 1..7: note = n-mer motif
MGSTTGV

SEQ ID NO: 4017 - protein, 7 aa, synthetic construct
  REGION 1..7: note = n-mer motif
VVAGHAM

SEQ ID NO: 4018 - protein, 7 aa, synthetic construct
  REGION 1..7: note = n-mer motif
GNEKPSG

SEQ ID NO: 4019 - protein, 7 aa, synthetic construct
  REGION 1..7: note = n-mer motif
RGTEGTP

SEQ ID NO: 4020 - protein, 7 aa, synthetic construct
  REGION 1..7: note = n-mer motif
WSPGPEA

SEQ ID NO: 4021 - protein, 7 aa, synthetic construct
  REGION 1..7: note = n-mer motif
INVNQMA

SEQ ID NO: 4022 - protein, 7 aa, synthetic construct
  REGION 1..7: note = n-mer motif
RSDVMQS

SEQ ID NO: 4023 - protein, 7 aa, synthetic construct
  REGION 1..7: note = n-mer motif
RDVSTKE

SEQ ID NO: 4024 - protein, 7 aa, synthetic construct
  REGION 1..7: note = n-mer motif
KKSPRLE

SEQ ID NO: 4025 - protein, 7 aa, synthetic construct
  REGION 1..7: note = n-mer motif
TSNTMSD

SEQ ID NO: 4026 - protein, 7 aa, synthetic construct
  REGION 1..7: note = n-mer motif
SKGNEQM

SEQ ID NO: 4027 - protein, 7 aa, synthetic construct
  REGION 1..7: note = n-mer motif
GYATTVQ

SEQ ID NO: 4028 - protein, 7 aa, synthetic construct
  REGION 1..7: note = n-mer motif
GYMSNVI

SEQ ID NO: 4029 - protein, 7 aa, synthetic construct
  REGION 1..7: note = n-mer motif
VTVSLDG

SEQ ID NO: 4030 - protein, 7 aa, synthetic construct
  REGION 1..7: note = n-mer motif
TNNLLAQ

SEQ ID NO: 4031 - protein, 7 aa, synthetic construct
  REGION 1..7: note = n-mer motif
AQTTGYT

SEQ ID NO: 4032 - protein, 7 aa, synthetic construct
  REGION 1..7: note = n-mer motif
SKSTEIM

SEQ ID NO: 4033 - protein, 7 aa, synthetic construct
  REGION 1..7: note = n-mer motif
SAMHTLV

SEQ ID NO: 4034 - protein, 7 aa, synthetic construct
  REGION 1..7: note = n-mer motif
AGVRESF

SEQ ID NO: 4035 - protein, 7 aa, synthetic construct
  REGION 1..7: note = n-mer motif
QGNSMAS

SEQ ID NO: 4036 - protein, 7 aa, synthetic construct
  REGION 1..7: note = n-mer motif
KNPSVQE

SEQ ID NO: 4037 - protein, 7 aa, synthetic construct
  REGION 1..7: note = n-mer motif
PITRESG

SEQ ID NO: 4038 - protein, 7 aa, synthetic construct
  REGION 1..7: note = n-mer motif
SRSAEIS

SEQ ID NO: 4039 - protein, 7 aa, synthetic construct
  REGION 1..7: note = n-mer motif
NDIPTRA

SEQ ID NO: 4040 - protein, 7 aa, synthetic construct
  REGION 1..7: note = n-mer motif
AYGSSGR

SEQ ID NO: 4041 - protein, 7 aa, synthetic construct
  REGION 1..7: note = n-mer motif
LHGNFSQ

SEQ ID NO: 4042 - protein, 7 aa, synthetic construct
  REGION 1..7: note = n-mer motif
ASNGQVN

SEQ ID NO: 4043 - protein, 7 aa, synthetic construct
  REGION 1..7: note = n-mer motif
QKGTVTL

SEQ ID NO: 4044 - protein, 7 aa, synthetic construct
  REGION 1..7: note = n-mer motif
NSSNTGW

SEQ ID NO: 4045 - protein, 7 aa, synthetic construct
  REGION 1..7: note = n-mer motif
TYQHQGP

SEQ ID NO: 4046 - protein, 7 aa, synthetic construct
  REGION 1..7: note = n-mer motif
DGVAHRS

SEQ ID NO: 4047 - protein, 7 aa, synthetic construct
  REGION 1..7: note = n-mer motif
DGLTLER

SEQ ID NO: 4048 - protein, 7 aa, synthetic construct
  REGION 1..7: note = n-mer motif
RGDLSTP

SEQ ID NO: 4049 - protein, 7 aa, synthetic construct
  REGION 1..7: note = n-mer motif
INEIGRM

SEQ ID NO: 4050 - protein, 7 aa, synthetic construct
  REGION 1..7: note = n-mer motif
PQWGTDP

SEQ ID NO: 4051 - protein, 7 aa, synthetic construct
  REGION 1..7: note = n-mer motif
KQVAHID

SEQ ID NO: 4052 - protein, 7 aa, synthetic construct
  REGION 1..7: note = n-mer motif
NTLQNSH

SEQ ID NO: 4053 - protein, 7 aa, synthetic construct
  REGION 1..7: note = n-mer motif
WSQGNTA

SEQ ID NO: 4054 - protein, 7 aa, synthetic construct
  REGION 1..7: note = n-mer motif
NETHVPK

SEQ ID NO: 4055 - protein, 7 aa, synthetic construct
  REGION 1..7: note = n-mer motif
VTNESRA

SEQ ID NO: 4056 - protein, 7 aa, synthetic construct
  REGION 1..7: note = n-mer motif
PEGHMQD

SEQ ID NO: 4057 - protein, 7 aa, synthetic construct
  REGION 1..7: note = n-mer motif
LDSTNSR

SEQ ID NO: 4058 - protein, 7 aa, synthetic construct
  REGION 1..7: note = n-mer motif
QSIGHPV

SEQ ID NO: 4059 - protein, 7 aa, synthetic construct
  REGION 1..7: note = n-mer motif
VLVNVHN

SEQ ID NO: 4060 - protein, 7 aa, synthetic construct
  REGION 1..7: note = n-mer motif
VHNPTTT

SEQ ID NO: 4061 - protein, 7 aa, synthetic construct
  REGION 1..7: note = n-mer motif
GDKASLA

SEQ ID NO: 4062 - protein, 7 aa, synthetic construct
  REGION 1..7: note = n-mer motif
LNESRAS

SEQ ID NO: 4063 - protein, 7 aa, synthetic construct
  REGION 1..7: note = n-mer motif
GFHINGE

SEQ ID NO: 4064 - protein, 7 aa, synthetic construct
  REGION 1..7: note = n-mer motif
SVSSVVL

SEQ ID NO: 4065 - protein, 7 aa, synthetic construct
  REGION 1..7: note = n-mer motif
LSTTSTK

SEQ ID NO: 4066 - protein, 7 aa, synthetic construct
  REGION 1..7: note = n-mer motif
TNTQNNP

SEQ ID NO: 4067 - protein, 7 aa, synthetic construct
  REGION 1..7: note = n-mer motif
TNLAVTL

SEQ ID NO: 4068 - protein, 7 aa, synthetic construct
  REGION 1..7: note = n-mer motif
MSDRTSD

SEQ ID NO: 4069 - protein, 7 aa, synthetic construct
  REGION 1..7: note = n-mer motif
SAQSFVV

SEQ ID NO: 4070 - protein, 7 aa, synthetic construct
  REGION 1..7: note = n-mer motif
MHTSRPP

SEQ ID NO: 4071 - protein, 7 aa, synthetic construct
  REGION 1..7: note = n-mer motif
MSSHTVQ

SEQ ID NO: 4072 - protein, 7 aa, synthetic construct
  REGION 1..7: note = n-mer motif
RDTAKGV

SEQ ID NO: 4073 - protein, 7 aa, synthetic construct
  REGION 1..7: note = n-mer motif
ALKSDSA

SEQ ID NO: 4074 - protein, 7 aa, synthetic construct
  REGION 1..7: note = n-mer motif
QYDASRQ

SEQ ID NO: 4075 - protein, 7 aa, synthetic construct
  REGION 1..7: note = n-mer motif
LADSNSK

SEQ ID NO: 4076 - protein, 7 aa, synthetic construct
  REGION 1..7: note = n-mer motif
FQLASNP

SEQ ID NO: 4077 - protein, 7 aa, synthetic construct
  REGION 1..7: note = n-mer motif
NSVVGNI

SEQ ID NO: 4078 - protein, 7 aa, synthetic construct
  REGION 1..7: note = n-mer motif
RYESTSA

SEQ ID NO: 4079 - protein, 7 aa, synthetic construct
  REGION 1..7: note = n-mer motif
ADHNHIA

SEQ ID NO: 4080 - protein, 7 aa, synthetic construct
  REGION 1..7: note = n-mer motif
VGDQSRP

SEQ ID NO: 4081 - protein, 7 aa, synthetic construct
  REGION 1..7: note = n-mer motif
FNETAGR

SEQ ID NO: 4082 - protein, 7 aa, synthetic construct
  REGION 1..7: note = n-mer motif
SNSYLLN

SEQ ID NO: 4083 - protein, 7 aa, synthetic construct
  REGION 1..7: note = n-mer motif
RGDTKNY

SEQ ID NO: 4084 - protein, 7 aa, synthetic construct
  REGION 1..7: note = n-mer motif
TTTTMAY

SEQ ID NO: 4085 - protein, 7 aa, synthetic construct
  REGION 1..7: note = n-mer motif
RPPNENR

SEQ ID NO: 4086 - protein, 7 aa, synthetic construct
  REGION 1..7: note = n-mer motif
CANMTNG

SEQ ID NO: 4087 - protein, 7 aa, synthetic construct
  REGION 1..7: note = n-mer motif
NRSDSFA

SEQ ID NO: 4088 - protein, 7 aa, synthetic construct
  REGION 1..7: note = n-mer motif
NLLTSSP

SEQ ID NO: 4089 - protein, 7 aa, synthetic construct
  REGION 1..7: note = n-mer motif
NSREMGV

SEQ ID NO: 4090 - protein, 7 aa, synthetic construct
  REGION 1..7: note = n-mer motif
MGNQSGA

SEQ ID NO: 4091 - protein, 7 aa, synthetic construct
  REGION 1..7: note = n-mer motif
MLTETKA

SEQ ID NO: 4092 - protein, 7 aa, synthetic construct
  REGION 1..7: note = n-mer motif
QNIKNMT

SEQ ID NO: 4093 - protein, 7 aa, synthetic construct
  REGION 1..7: note = n-mer motif
MSTVLRE

SEQ ID NO: 4094 - protein, 7 aa, synthetic construct
  REGION 1..7: note = n-mer motif
DRAQNNE

SEQ ID NO: 4095 - protein, 7 aa, synthetic construct
  REGION 1..7: note = n-mer motif
HTQSTGY

SEQ ID NO: 4096 - protein, 7 aa, synthetic construct
  REGION 1..7: note = n-mer motif
MSVGKVY

SEQ ID NO: 4097 - protein, 7 aa, synthetic construct
  REGION 1..7: note = n-mer motif
AGNYQSS

SEQ ID NO: 4098 - protein, 7 aa, synthetic construct
  REGION 1..7: note = n-mer motif
RNENVNA

SEQ ID NO: 4099 - protein, 7 aa, synthetic construct
  REGION 1..7: note = n-mer motif
DTHHTSS

SEQ ID NO: 4100 - protein, 7 aa, synthetic construct
  REGION 1..7: note = n-mer motif
TSSPVLQ

SEQ ID NO: 4101 - protein, 7 aa, synthetic construct
  REGION 1..7: note = n-mer motif
VGRDAEA

SEQ ID NO: 4102 - protein, 7 aa, synthetic construct
  REGION 1..7: note = n-mer motif
NMERGSQ

SEQ ID NO: 4103 - protein, 7 aa, synthetic construct
  REGION 1..7: note = n-mer motif
DRQTGQK

SEQ ID NO: 4104 - protein, 7 aa, synthetic construct
  REGION 1..7: note = n-mer motif
VFREGIV

SEQ ID NO: 4105 - protein, 7 aa, synthetic construct
  REGION 1..7: note = n-mer motif
SANNIAT

SEQ ID NO: 4106 - protein, 7 aa, synthetic construct
  REGION 1..7: note = n-mer motif
VSEGQRI

SEQ ID NO: 4107 - protein, 7 aa, synthetic construct
  REGION 1..7: note = n-mer motif
HYGNKDI

SEQ ID NO: 4108 - protein, 7 aa, synthetic construct
  REGION 1..7: note = n-mer motif
DVLLKNF

SEQ ID NO: 4109 - protein, 7 aa, synthetic construct
  REGION 1..7: note = n-mer motif
HTVQIRE

SEQ ID NO: 4110 - protein, 7 aa, synthetic construct
  REGION 1..7: note = n-mer motif
TSALAHQ

SEQ ID NO: 4111 - protein, 7 aa, synthetic construct
  REGION 1..7: note = n-mer motif
IPTGQTS

SEQ ID NO: 4112 - protein, 7 aa, synthetic construct
  REGION 1..7: note = n-mer motif
RSDKGTL

SEQ ID NO: 4113 - protein, 7 aa, synthetic construct
  REGION 1..7: note = n-mer motif
NGLTVQR

SEQ ID NO: 4114 - protein, 7 aa, synthetic construct
  REGION 1..7: note = n-mer motif
TVEGSYP

SEQ ID NO: 4115 - protein, 7 aa, synthetic construct
  REGION 1..7: note = n-mer motif
TSHLVLA

SEQ ID NO: 4116 - protein, 7 aa, synthetic construct
  REGION 1..7: note = n-mer motif
NHSLSEH

SEQ ID NO: 4117 - protein, 7 aa, synthetic construct
  REGION 1..7: note = n-mer motif
LTGMNRD

SEQ ID NO: 4118 - protein, 7 aa, synthetic construct
  REGION 1..7: note = n-mer motif
SHNAGVA

SEQ ID NO: 4119 - protein, 7 aa, synthetic construct
  REGION 1..7: note = n-mer motif
AHQTAGP

SEQ ID NO: 4120 - protein, 7 aa, synthetic construct
  REGION 1..7: note = n-mer motif
NSHDLKY

SEQ ID NO: 4121 - protein, 7 aa, synthetic construct
  REGION 1..7: note = n-mer motif
TTMSTGQ

SEQ ID NO: 4122 - protein, 7 aa, synthetic construct
  REGION 1..7: note = n-mer motif
GFGHVPE

SEQ ID NO: 4123 - protein, 7 aa, synthetic construct
  REGION 1..7: note = n-mer motif
ITAASPQ

SEQ ID NO: 4124 - protein, 7 aa, synthetic construct
  REGION 1..7: note = n-mer motif
VKASAGD

SEQ ID NO: 4125 - protein, 7 aa, synthetic construct
  REGION 1..7: note = n-mer motif
SITHSNT

SEQ ID NO: 4126 - protein, 7 aa, synthetic construct
  REGION 1..7: note = n-mer motif
HNNNMLN

SEQ ID NO: 4127 - protein, 7 aa, synthetic construct
  REGION 1..7: note = n-mer motif
PKTLTST

SEQ ID NO: 4128 - protein, 7 aa, synthetic construct
  REGION 1..7: note = n-mer motif
ITGNTVG

SEQ ID NO: 4129 - protein, 7 aa, synthetic construct
  REGION 1..7: note = n-mer motif
LGNHYTP

SEQ ID NO: 4130 - protein, 7 aa, synthetic construct
  REGION 1..7: note = n-mer motif
SFTNTNP

SEQ ID NO: 4131 - protein, 7 aa, synthetic construct
  REGION 1..7: note = n-mer motif
TLDRNQT

SEQ ID NO: 4132 - protein, 7 aa, synthetic construct
  REGION 1..7: note = n-mer motif
ISTQRPH

SEQ ID NO: 4133 - protein, 7 aa, synthetic construct
  REGION 1..7: note = n-mer motif
TFTTLGK

SEQ ID NO: 4134 - protein, 7 aa, synthetic construct
  REGION 1..7: note = n-mer motif
EKPSLVM

SEQ ID NO: 4135 - protein, 7 aa, synthetic construct
  REGION 1..7: note = n-mer motif
HIETNTS

SEQ ID NO: 4136 - protein, 7 aa, synthetic construct
  REGION 1..7: note = n-mer motif
GTKDILI

SEQ ID NO: 4137 - protein, 7 aa, synthetic construct
  REGION 1..7: note = n-mer motif
ATFSHAG

SEQ ID NO: 4138 - protein, 7 aa, synthetic construct
  REGION 1..7: note = n-mer motif
ANGIFQP

SEQ ID NO: 4139 - protein, 7 aa, synthetic construct
  REGION 1..7: note = n-mer motif
LNVNTLN

SEQ ID NO: 4140 - protein, 7 aa, synthetic construct
  REGION 1..7: note = n-mer motif
TSASENW

SEQ ID NO: 4141 - protein, 7 aa, synthetic construct
  REGION 1..7: note = n-mer motif
LLQGATK

SEQ ID NO: 4142 - protein, 7 aa, synthetic construct
  REGION 1..7: note = n-mer motif
ALETTRA

SEQ ID NO: 4143 - protein, 7 aa, synthetic construct
  REGION 1..7: note = n-mer motif
LTGQNEF

SEQ ID NO: 4144 - protein, 7 aa, synthetic construct
  REGION 1..7: note = n-mer motif
ISHDLKN

SEQ ID NO: 4145 - protein, 7 aa, synthetic construct
  REGION 1..7: note = n-mer motif
AQYNNGV

SEQ ID NO: 4146 - protein, 7 aa, synthetic construct
  REGION 1..7: note = n-mer motif
TTSVEKT

SEQ ID NO: 4147 - protein, 7 aa, synthetic construct
  REGION 1..7: note = n-mer motif
GTSAIMP

SEQ ID NO: 4148 - protein, 7 aa, synthetic construct
  REGION 1..7: note = n-mer motif
QLQGTEA

SEQ ID NO: 4149 - protein, 7 aa, synthetic construct
  REGION 1..7: note = n-mer motif
ALKSQEP

SEQ ID NO: 4150 - protein, 7 aa, synthetic construct
  REGION 1..7: note = n-mer motif
SNSSVAV

SEQ ID NO: 4151 - protein, 7 aa, synthetic construct
  REGION 1..7: note = n-mer motif
NHGRAID

SEQ ID NO: 4152 - protein, 7 aa, synthetic construct
  REGION 1..7: note = n-mer motif
DTYNSNT

SEQ ID NO: 4153 - protein, 7 aa, synthetic construct
  REGION 1..7: note = n-mer motif
TFHQAVK

SEQ ID NO: 4154 - protein, 7 aa, synthetic construct
  REGION 1..7: note = n-mer motif
WHTGVFQ

SEQ ID NO: 4155 - protein, 7 aa, synthetic construct
  REGION 1..7: note = n-mer motif
RGDLSTP

SEQ ID NO: 4156 - protein, 7 aa, synthetic construct
  REGION 1..7: note = n-mer motif
MLSQVLT

SEQ ID NO: 4157 - protein, 7 aa, synthetic construct
  REGION 1..7: note = n-mer motif
ENEKRES

SEQ ID NO: 4158 - protein, 7 aa, synthetic construct
  REGION 1..7: note = n-mer motif
ISSYDGN

SEQ ID NO: 4159 - protein, 7 aa, synthetic construct
  REGION 1..7: note = n-mer motif
TRGDMEF

SEQ ID NO: 4160 - protein, 7 aa, synthetic construct
  REGION 1..7: note = n-mer motif
NVQNVPG

SEQ ID NO: 4161 - protein, 7 aa, synthetic construct
  REGION 1..7: note = n-mer motif
SFTNTNP

SEQ ID NO: 4162 - protein, 7 aa, synthetic construct
  REGION 1..7: note = n-mer motif
SNAGYHS

SEQ ID NO: 4163 - protein, 7 aa, synthetic construct
  REGION 1..7: note = n-mer motif
DYKNSAP

SEQ ID NO: 4164 - protein, 7 aa, synthetic construct
  REGION 1..7: note = n-mer motif
VGKNSYE

SEQ ID NO: 4165 - protein, 7 aa, synthetic construct
  REGION 1..7: note = n-mer motif
AYAGVLG

SEQ ID NO: 4166 - protein, 7 aa, synthetic construct
  REGION 1..7: note = n-mer motif
TTSERVN

SEQ ID NO: 4167 - protein, 7 aa, synthetic construct
  REGION 1..7: note = n-mer motif
DTGIKNV

SEQ ID NO: 4168 - protein, 7 aa, synthetic construct
  REGION 1..7: note = n-mer motif
STSSLVP

SEQ ID NO: 4169 - protein, 7 aa, synthetic construct
  REGION 1..7: note = n-mer motif
WSAGERV

SEQ ID NO: 4170 - protein, 7 aa, synthetic construct
  REGION 1..7: note = n-mer motif
SSGSLIT

SEQ ID NO: 4171 - protein, 7 aa, synthetic construct
  REGION 1..7: note = n-mer motif
WISTEMR

SEQ ID NO: 4172 - protein, 7 aa, synthetic construct
  REGION 1..7: note = n-mer motif
FAAGAHG

SEQ ID NO: 4173 - protein, 7 aa, synthetic construct
  REGION 1..7: note = n-mer motif
IGDRDQR

SEQ ID NO: 4174 - protein, 7 aa, synthetic construct
  REGION 1..7: note = n-mer motif
STIGNST

SEQ ID NO: 4175 - protein, 7 aa, synthetic construct
  REGION 1..7: note = n-mer motif
GSGTVGR

SEQ ID NO: 4176 - protein, 7 aa, synthetic construct
  REGION 1..7: note = n-mer motif
HVTAVVD

SEQ ID NO: 4177 - protein, 7 aa, synthetic construct
  REGION 1..7: note = n-mer motif
DKAGVAN

SEQ ID NO: 4178 - protein, 7 aa, synthetic construct
  REGION 1..7: note = n-mer motif
RLTDTMH

SEQ ID NO: 4179 - protein, 7 aa, synthetic construct
  REGION 1..7: note = n-mer motif
LNTLIHK

SEQ ID NO: 4180 - protein, 7 aa, synthetic construct
  REGION 1..7: note = n-mer motif
SYQNPPP

SEQ ID NO: 4181 - protein, 7 aa, synthetic construct
  REGION 1..7: note = n-mer motif
LTGLNAF

SEQ ID NO: 4182 - protein, 7 aa, synthetic construct
  REGION 1..7: note = n-mer motif
SPVLSPS

SEQ ID NO: 4183 - protein, 7 aa, synthetic construct
  REGION 1..7: note = n-mer motif
VQTHIGV

SEQ ID NO: 4184 - protein, 7 aa, synthetic construct
  REGION 1..7: note = n-mer motif
HMSSVAT

SEQ ID NO: 4185 - protein, 7 aa, synthetic construct
  REGION 1..7: note = n-mer motif
GKANDGS

SEQ ID NO: 4186 - protein, 7 aa, synthetic construct
  REGION 1..7: note = n-mer motif
STNDERK

SEQ ID NO: 4187 - protein, 7 aa, synthetic construct
  REGION 1..7: note = n-mer motif
QGGNSRF

SEQ ID NO: 4188 - protein, 7 aa, synthetic construct
  REGION 1..7: note = n-mer motif
PNNEKNP

SEQ ID NO: 4189 - protein, 7 aa, synthetic construct
  REGION 1..7: note = n-mer motif
VAATGGT

SEQ ID NO: 4190 - protein, 7 aa, synthetic construct
  REGION 1..7: note = n-mer motif
AIVDRGS

SEQ ID NO: 4191 - protein, 7 aa, synthetic construct
  REGION 1..7: note = n-mer motif
SQHHTPL

SEQ ID NO: 4192 - protein, 7 aa, synthetic construct
  REGION 1..7: note = n-mer motif
LQSSMNV

SEQ ID NO: 4193 - protein, 7 aa, synthetic construct
  REGION 1..7: note = n-mer motif
RETNPSE

SEQ ID NO: 4194 - protein, 7 aa, synthetic construct
  REGION 1..7: note = n-mer motif
GFGHLPE

SEQ ID NO: 4195 - protein, 7 aa, synthetic construct
  REGION 1..7: note = n-mer motif
RNATVTV

SEQ ID NO: 4196 - protein, 7 aa, synthetic construct
  REGION 1..7: note = n-mer motif
VSNASGL

SEQ ID NO: 4197 - protein, 7 aa, synthetic construct
  REGION 1..7: note = n-mer motif
DRPNNES

SEQ ID NO: 4198 - protein, 7 aa, synthetic construct
  REGION 1..7: note = n-mer motif
QVSLVKL

SEQ ID NO: 4199 - protein, 7 aa, synthetic construct
  REGION 1..7: note = n-mer motif
SNMREEI

SEQ ID NO: 4200 - protein, 7 aa, synthetic construct
  REGION 1..7: note = n-mer motif
DIGRSNS

SEQ ID NO: 4201 - protein, 7 aa, synthetic construct
  REGION 1..7: note = n-mer motif
DHMNLRS

SEQ ID NO: 4202 - protein, 7 aa, synthetic construct
  REGION 1..7: note = n-mer motif
IERSSDR

SEQ ID NO: 4203 - protein, 7 aa, synthetic construct
  REGION 1..7: note = n-mer motif
LSQNFNP

SEQ ID NO: 4204 - protein, 7 aa, synthetic construct
  REGION 1..7: note = n-mer motif
YSMGQQP

SEQ ID NO: 4205 - protein, 7 aa, synthetic construct
  REGION 1..7: note = n-mer motif
YTQGIMN

SEQ ID NO: 4206 - protein, 7 aa, synthetic construct
  REGION 1..7: note = n-mer motif
MLSHGAL

SEQ ID NO: 4207 - protein, 7 aa, synthetic construct
  REGION 1..7: note = n-mer motif
AYNARLP

SEQ ID NO: 4208 - protein, 7 aa, synthetic construct
  REGION 1..7: note = n-mer motif
RHYSDNA

SEQ ID NO: 4209 - protein, 7 aa, synthetic construct
  REGION 1..7: note = n-mer motif
AHTAMTY

SEQ ID NO: 4210 - protein, 7 aa, synthetic construct
  REGION 1..7: note = n-mer motif
LTGSDMK

SEQ ID NO: 4211 - protein, 7 aa, synthetic construct
  REGION 1..7: note = n-mer motif
TLHTKDL

SEQ ID NO: 4212 - protein, 7 aa, synthetic construct
  REGION 1..7: note = n-mer motif
SGQNGTS

SEQ ID NO: 4213 - protein, 7 aa, synthetic construct
  REGION 1..7: note = n-mer motif
RGDVHTN

SEQ ID NO: 4214 - protein, 7 aa, synthetic construct
  REGION 1..7: note = n-mer motif
TGTATLP

SEQ ID NO: 4215 - protein, 7 aa, synthetic construct
  REGION 1..7: note = n-mer motif
LGTLLSQ

SEQ ID NO: 4216 - protein, 7 aa, synthetic construct
  REGION 1..7: note = n-mer motif
VLSSNLY

SEQ ID NO: 4217 - protein, 7 aa, synthetic construct
  REGION 1..7: note = n-mer motif
SLGSDRM

SEQ ID NO: 4218 - protein, 7 aa, synthetic construct
  REGION 1..7: note = n-mer motif
RGDLSTP

SEQ ID NO: 4219 - protein, 7 aa, synthetic construct
  REGION 1..7: note = n-mer motif
RMSESSD

SEQ ID NO: 4220 - protein, 7 aa, synthetic construct
  REGION 1..7: note = n-mer motif
MTEKASI

SEQ ID NO: 4221 - protein, 6 aa, synthetic construct
  REGION 1..6: note = n-mer motif
TEQSYR

SEQ ID NO: 4222 - protein, 7 aa, synthetic construct
  REGION 1..7: note = n-mer motif
VESKSEP

SEQ ID NO: 4223 - protein, 7 aa, synthetic construct
  REGION 1..7: note = n-mer motif
MNLVRDS

SEQ ID NO: 4224 - protein, 7 aa, synthetic construct
  REGION 1..7: note = n-mer motif
QNHSITT

SEQ ID NO: 4225 - protein, 7 aa, synthetic construct
  REGION 1..7: note = n-mer motif
TLDNNHS

SEQ ID NO: 4226 - protein, 7 aa, synthetic construct
  REGION 1..7: note = n-mer motif
TKSFNDL

SEQ ID NO: 4227 - protein, 7 aa, synthetic construct
  REGION 1..7: note = n-mer motif
ATEHSGR

SEQ ID NO: 4228 - protein, 7 aa, synthetic construct
  REGION 1..7: note = n-mer motif
QGTLLSP

SEQ ID NO: 4229 - protein, 7 aa, synthetic construct
  REGION 1..7: note = n-mer motif
TFHQGVK

SEQ ID NO: 4230 - protein, 7 aa, synthetic construct
  REGION 1..7: note = n-mer motif
CQRADCA

SEQ ID NO: 4231 - protein, 7 aa, synthetic construct
  REGION 1..7: note = n-mer motif
RYDGTLN

SEQ ID NO: 4232 - protein, 7 aa, synthetic construct
  REGION 1..7: note = n-mer motif
QGGTNNP

SEQ ID NO: 4233 - protein, 7 aa, synthetic construct
  REGION 1..7: note = n-mer motif
GGNYHTT

SEQ ID NO: 4234 - protein, 7 aa, synthetic construct
  REGION 1..7: note = n-mer motif
LVVQSAQ

SEQ ID NO: 4235 - protein, 7 aa, synthetic construct
  REGION 1..7: note = n-mer motif
YPHESKN

SEQ ID NO: 4236 - protein, 7 aa, synthetic construct
  REGION 1..7: note = n-mer motif
EIVRHTH

SEQ ID NO: 4237 - protein, 7 aa, synthetic construct
  REGION 1..7: note = n-mer motif
DRTNNMS

SEQ ID NO: 4238 - protein, 7 aa, synthetic construct
  REGION 1..7: note = n-mer motif
SVTNGAE

SEQ ID NO: 4239 - protein, 7 aa, synthetic construct
  REGION 1..7: note = n-mer motif
SGQKNSE

SEQ ID NO: 4240 - protein, 7 aa, synthetic construct
  REGION 1..7: note = n-mer motif
EQKKTDH

SEQ ID NO: 4241 - protein, 7 aa, synthetic construct
  REGION 1..7: note = n-mer motif
NINGGGN

SEQ ID NO: 4242 - protein, 7 aa, synthetic construct
  REGION 1..7: note = n-mer motif
KLHTKDL

SEQ ID NO: 4243 - protein, 7 aa, synthetic construct
  REGION 1..7: note = n-mer motif
SFLVAHP

SEQ ID NO: 4244 - protein, 7 aa, synthetic construct
  REGION 1..7: note = n-mer motif
YQQNIEI

SEQ ID NO: 4245 - protein, 7 aa, synthetic construct
  REGION 1..7: note = n-mer motif
RGDLSTT

SEQ ID NO: 4246 - protein, 7 aa, synthetic construct
  REGION 1..7: note = n-mer motif
ANLNLTS

SEQ ID NO: 4247 - protein, 7 aa, synthetic construct
  REGION 1..7: note = n-mer motif
TVQHAAT

SEQ ID NO: 4248 - protein, 7 aa, synthetic construct
  REGION 1..7: note = n-mer motif
TVNLLAA

SEQ ID NO: 4249 - protein, 7 aa, synthetic construct
  REGION 1..7: note = n-mer motif
NQRVEQK

SEQ ID NO: 4250 - protein, 7 aa, synthetic construct
  REGION 1..7: note = n-mer motif
NTYTAAK

SEQ ID NO: 4251 - protein, 7 aa, synthetic construct
  REGION 1..7: note = n-mer motif
IQRDVGH

SEQ ID NO: 4252 - protein, 7 aa, synthetic construct
  REGION 1..7: note = n-mer motif
ISEMTRY

SEQ ID NO: 4253 - protein, 7 aa, synthetic construct
  REGION 1..7: note = n-mer motif
IATNVIY

SEQ ID NO: 4254 - protein, 7 aa, synthetic construct
  REGION 1..7: note = n-mer motif
NGNHSID

SEQ ID NO: 4255 - protein, 7 aa, synthetic construct
  REGION 1..7: note = n-mer motif
TSIGSAK

SEQ ID NO: 4256 - protein, 7 aa, synthetic construct
  REGION 1..7: note = n-mer motif
NVHSVDK

SEQ ID NO: 4257 - protein, 7 aa, synthetic construct
  REGION 1..7: note = n-mer motif
ELSVPKP

SEQ ID NO: 4258 - protein, 7 aa, synthetic construct
  REGION 1..7: note = n-mer motif
FLDKYNY

SEQ ID NO: 4259 - protein, 7 aa, synthetic construct
  REGION 1..7: note = n-mer motif
YIPNNSG

SEQ ID NO: 4260 - protein, 7 aa, synthetic construct
  REGION 1..7: note = n-mer motif
GLGQPQL

SEQ ID NO: 4261 - protein, 7 aa, synthetic construct
  REGION 1..7: note = n-mer motif
EGSQGNH

SEQ ID NO: 4262 - protein, 7 aa, synthetic construct
  REGION 1..7: note = n-mer motif
NIYMASG

SEQ ID NO: 4263 - protein, 7 aa, synthetic construct
  REGION 1..7: note = n-mer motif
NLQTGVQ

SEQ ID NO: 4264 - protein, 7 aa, synthetic construct
  REGION 1..7: note = n-mer motif
TVAPYSS

SEQ ID NO: 4265 - protein, 7 aa, synthetic construct
  REGION 1..7: note = n-mer motif
SNYSDGI

SEQ ID NO: 4266 - protein, 7 aa, synthetic construct
  REGION 1..7: note = n-mer motif
ATYVVGT

SEQ ID NO: 4267 - protein, 7 aa, synthetic construct
  REGION 1..7: note = n-mer motif
SREAGST

SEQ ID NO: 4268 - protein, 7 aa, synthetic construct
  REGION 1..7: note = n-mer motif
AGKTHAD

SEQ ID NO: 4269 - protein, 7 aa, synthetic construct
  REGION 1..7: note = n-mer motif
PLSLHNS

SEQ ID NO: 4270 - protein, 7 aa, synthetic construct
  REGION 1..7: note = n-mer motif
LRDLNGG

SEQ ID NO: 4271 - protein, 7 aa, synthetic construct
  REGION 1..7: note = n-mer motif
DRTYSNT

SEQ ID NO: 4272 - protein, 7 aa, synthetic construct
  REGION 1..7: note = n-mer motif
SVTSGTQ

SEQ ID NO: 4273 - protein, 7 aa, synthetic construct
  REGION 1..7: note = n-mer motif
NMTSAYH

SEQ ID NO: 4274 - protein, 7 aa, synthetic construct
  REGION 1..7: note = n-mer motif
VMGGPGI

SEQ ID NO: 4275 - protein, 7 aa, synthetic construct
  REGION 1..7: note = n-mer motif
AGTHTDK

SEQ ID NO: 4276 - protein, 7 aa, synthetic construct
  REGION 1..7: note = n-mer motif
GTMNIGI

SEQ ID NO: 4277 - protein, 7 aa, synthetic construct
  REGION 1..7: note = n-mer motif
TAGGERA

SEQ ID NO: 4278 - protein, 7 aa, synthetic construct
  REGION 1..7: note = n-mer motif
GMTSNQV

SEQ ID NO: 4279 - protein, 7 aa, synthetic construct
  REGION 1..7: note = n-mer motif
HFSQITN

SEQ ID NO: 4280 - protein, 7 aa, synthetic construct
  REGION 1..7: note = n-mer motif
SRIENNN

SEQ ID NO: 4281 - protein, 7 aa, synthetic construct
  REGION 1..7: note = n-mer motif
DTASYNN

SEQ ID NO: 4282 - protein, 7 aa, synthetic construct
  REGION 1..7: note = n-mer motif
VNQSPGA

SEQ ID NO: 4283 - protein, 7 aa, synthetic construct
  REGION 1..7: note = n-mer motif
NNMGHGH

SEQ ID NO: 4284 - protein, 7 aa, synthetic construct
  REGION 1..7: note = n-mer motif
SRLSQDP

SEQ ID NO: 4285 - protein, 7 aa, synthetic construct
  REGION 1..7: note = n-mer motif
STSQAVQ

SEQ ID NO: 4286 - protein, 7 aa, synthetic construct
  REGION 1..7: note = n-mer motif
RWQGLSA

SEQ ID NO: 4287 - protein, 7 aa, synthetic construct
  REGION 1..7: note = n-mer motif
AHMHSEL

SEQ ID NO: 4288 - protein, 7 aa, synthetic construct
  REGION 1..7: note = n-mer motif
NNLTNST

SEQ ID NO: 4289 - protein, 7 aa, synthetic construct
  REGION 1..7: note = n-mer motif
QPSASEL

SEQ ID NO: 4290 - protein, 7 aa, synthetic construct
  REGION 1..7: note = n-mer motif
GTSLENR

SEQ ID NO: 4291 - protein, 7 aa, synthetic construct
  REGION 1..7: note = n-mer motif
LSNSITP

SEQ ID NO: 4292 - protein, 7 aa, synthetic construct
  REGION 1..7: note = n-mer motif
TIVSTSY

SEQ ID NO: 4293 - protein, 7 aa, synthetic construct
  REGION 1..7: note = n-mer motif
TLGYPDK

SEQ ID NO: 4294 - protein, 7 aa, synthetic construct
  REGION 1..7: note = n-mer motif
SRHDVRN

SEQ ID NO: 4295 - protein, 7 aa, synthetic construct
  REGION 1..7: note = n-mer motif
NGSVANP

SEQ ID NO: 4296 - protein, 7 aa, synthetic construct
  REGION 1..7: note = n-mer motif
AMDGYRV

SEQ ID NO: 4297 - protein, 7 aa, synthetic construct
  REGION 1..7: note = n-mer motif
WTGAQPS

SEQ ID NO: 4298 - protein, 7 aa, synthetic construct
  REGION 1..7: note = n-mer motif
KNGAIGT

SEQ ID NO: 4299 - protein, 7 aa, synthetic construct
  REGION 1..7: note = n-mer motif
VLPSRIA

SEQ ID NO: 4300 - protein, 7 aa, synthetic construct
  REGION 1..7: note = n-mer motif
DNVNSQP

SEQ ID NO: 4301 - protein, 7 aa, synthetic construct
  REGION 1..7: note = n-mer motif
GVNASYS

SEQ ID NO: 4302 - protein, 7 aa, synthetic construct
  REGION 1..7: note = n-mer motif
LSHAMDR

SEQ ID NO: 4303 - protein, 7 aa, synthetic construct
  REGION 1..7: note = n-mer motif
RAHGDNQ

SEQ ID NO: 4304 - protein, 7 aa, synthetic construct
  REGION 1..7: note = n-mer motif
LQTPGTT

SEQ ID NO: 4305 - protein, 7 aa, synthetic construct
  REGION 1..7: note = n-mer motif
TQVVSIY

SEQ ID NO: 4306 - protein, 7 aa, synthetic construct
  REGION 1..7: note = n-mer motif
QVQGTLG

SEQ ID NO: 4307 - protein, 7 aa, synthetic construct
  REGION 1..7: note = n-mer motif
VGNQNLP

SEQ ID NO: 4308 - protein, 7 aa, synthetic construct
  REGION 1..7: note = n-mer motif
YVDYSKS

SEQ ID NO: 4309 - protein, 7 aa, synthetic construct
  REGION 1..7: note = n-mer motif
LLNSSGV

SEQ ID NO: 4310 - protein, 7 aa, synthetic construct
  REGION 1..7: note = n-mer motif
NQSLTMD

SEQ ID NO: 4311 - protein, 7 aa, synthetic construct
  REGION 1..7: note = n-mer motif
AGKDLSN

SEQ ID NO: 4312 - protein, 7 aa, synthetic construct
  REGION 1..7: note = n-mer motif
SYVSVPA

SEQ ID NO: 4313 - protein, 7 aa, synthetic construct
  REGION 1..7: note = n-mer motif
NEGRVQT

SEQ ID NO: 4314 - protein, 7 aa, synthetic construct
  REGION 1..7: note = n-mer motif
TLTQTGM

SEQ ID NO: 4315 - protein, 7 aa, synthetic construct
  REGION 1..7: note = n-mer motif
GFALTGT

SEQ ID NO: 4316 - protein, 7 aa, synthetic construct
  REGION 1..7: note = n-mer motif
QSTLNRP

SEQ ID NO: 4317 - protein, 7 aa, synthetic construct
  REGION 1..7: note = n-mer motif
TTTHSIS

SEQ ID NO: 4318 - protein, 7 aa, synthetic construct
  REGION 1..7: note = n-mer motif
NTHRQEY

SEQ ID NO: 4319 - protein, 7 aa, synthetic construct
  REGION 1..7: note = n-mer motif
SQIVNTT

SEQ ID NO: 4320 - protein, 7 aa, synthetic construct
  REGION 1..7: note = n-mer motif
LVLEMQT

SEQ ID NO: 4321 - protein, 7 aa, synthetic construct
  REGION 1..7: note = n-mer motif
NDISTQR

SEQ ID NO: 4322 - protein, 7 aa, synthetic construct
  REGION 1..7: note = n-mer motif
YTADKKQ

SEQ ID NO: 4323 - protein, 7 aa, synthetic construct
  REGION 1..7: note = n-mer motif
FGATTTA

SEQ ID NO: 4324 - protein, 7 aa, synthetic construct
  REGION 1..7: note = n-mer motif
VQISMNN

SEQ ID NO: 4325 - protein, 7 aa, synthetic construct
  REGION 1..7: note = n-mer motif
MHAQESR

SEQ ID NO: 4326 - protein, 7 aa, synthetic construct
  REGION 1..7: note = n-mer motif
HVNTADR

SEQ ID NO: 4327 - protein, 7 aa, synthetic construct
  REGION 1..7: note = n-mer motif
YSTDSTK

SEQ ID NO: 4328 - protein, 7 aa, synthetic construct
  REGION 1..7: note = n-mer motif
GHDRTPN

SEQ ID NO: 4329 - protein, 7 aa, synthetic construct
  REGION 1..7: note = n-mer motif
TSGVLTR

SEQ ID NO: 4330 - protein, 7 aa, synthetic construct
  REGION 1..7: note = n-mer motif
NIAMSKI

SEQ ID NO: 4331 - protein, 7 aa, synthetic construct
  REGION 1..7: note = n-mer motif
MGTEYRM

SEQ ID NO: 4332 - protein, 7 aa, synthetic construct
  REGION 1..7: note = n-mer motif
PYANRLE

SEQ ID NO: 4333 - protein, 7 aa, synthetic construct
  REGION 1..7: note = n-mer motif
PLQNNKT

SEQ ID NO: 4334 - protein, 7 aa, synthetic construct
  REGION 1..7: note = n-mer motif
SLTEKAP

SEQ ID NO: 4335 - protein, 7 aa, synthetic construct
  REGION 1..7: note = n-mer motif
NMVYTNV

SEQ ID NO: 4336 - protein, 7 aa, synthetic construct
  REGION 1..7: note = n-mer motif
MLSATQG

SEQ ID NO: 4337 - protein, 7 aa, synthetic construct
  REGION 1..7: note = n-mer motif
NMTHSTV

SEQ ID NO: 4338 - protein, 7 aa, synthetic construct
  REGION 1..7: note = n-mer motif
IYTNSHV

SEQ ID NO: 4339 - protein, 7 aa, synthetic construct
  REGION 1..7: note = n-mer motif
WSHDRPT

SEQ ID NO: 4340 - protein, 7 aa, synthetic construct
  REGION 1..7: note = n-mer motif
EKGTPSS

SEQ ID NO: 4341 - protein, 7 aa, synthetic construct
  REGION 1..7: note = n-mer motif
HHSTESL

SEQ ID NO: 4342 - protein, 7 aa, synthetic construct
  REGION 1..7: note = n-mer motif
PKSTQVM

SEQ ID NO: 4343 - protein, 7 aa, synthetic construct
  REGION 1..7: note = n-mer motif
SDRTAQQ

SEQ ID NO: 4344 - protein, 7 aa, synthetic construct
  REGION 1..7: note = n-mer motif
ATLARTS

SEQ ID NO: 4345 - protein, 7 aa, synthetic construct
  REGION 1..7: note = n-mer motif
ISQVSFN

SEQ ID NO: 4346 - protein, 7 aa, synthetic construct
  REGION 1..7: note = n-mer motif
HYGNKDI

SEQ ID NO: 4347 - protein, 7 aa, synthetic construct
  REGION 1..7: note = n-mer motif
NDGTDRR

SEQ ID NO: 4348 - protein, 7 aa, synthetic construct
  REGION 1..7: note = n-mer motif
TNHITGP

SEQ ID NO: 4349 - protein, 7 aa, synthetic construct
  REGION 1..7: note = n-mer motif
TNSNQSS

SEQ ID NO: 4350 - protein, 7 aa, synthetic construct
  REGION 1..7: note = n-mer motif
VATHYNE

SEQ ID NO: 4351 - protein, 7 aa, synthetic construct
  REGION 1..7: note = n-mer motif
DLGTART

SEQ ID NO: 4352 - protein, 7 aa, synthetic construct
  REGION 1..7: note = n-mer motif
ALSQSAG

SEQ ID NO: 4353 - protein, 7 aa, synthetic construct
  REGION 1..7: note = n-mer motif
KTTLHQA

SEQ ID NO: 4354 - protein, 7 aa, synthetic construct
  REGION 1..7: note = n-mer motif
MINAITP

SEQ ID NO: 4355 - protein, 7 aa, synthetic construct
  REGION 1..7: note = n-mer motif
GSTPGAS

SEQ ID NO: 4356 - protein, 7 aa, synthetic construct
  REGION 1..7: note = n-mer motif
NEKPQST

SEQ ID NO: 4357 - protein, 7 aa, synthetic construct
  REGION 1..7: note = n-mer motif
SLMGSAG

SEQ ID NO: 4358 - protein, 7 aa, synthetic construct
  REGION 1..7: note = n-mer motif
TDTLSER

SEQ ID NO: 4359 - protein, 7 aa, synthetic construct
  REGION 1..7: note = n-mer motif
ASQSEKN

SEQ ID NO: 4360 - protein, 7 aa, synthetic construct
  REGION 1..7: note = n-mer motif
AVRTPAM

SEQ ID NO: 4361 - protein, 7 aa, synthetic construct
  REGION 1..7: note = n-mer motif
PNASFGP

SEQ ID NO: 4362 - protein, 7 aa, synthetic construct
  REGION 1..7: note = n-mer motif
KAHVVEI

SEQ ID NO: 4363 - protein, 7 aa, synthetic construct
  REGION 1..7: note = n-mer motif
YISAPPM

SEQ ID NO: 4364 - protein, 7 aa, synthetic construct
  REGION 1..7: note = n-mer motif
PIQNESS

SEQ ID NO: 4365 - protein, 7 aa, synthetic construct
  REGION 1..7: note = n-mer motif
GVTNASK

SEQ ID NO: 4366 - protein, 7 aa, synthetic construct
  REGION 1..7: note = n-mer motif
VNGGKPV

SEQ ID NO: 4367 - protein, 7 aa, synthetic construct
  REGION 1..7: note = n-mer motif
SVLSSST

SEQ ID NO: 4368 - protein, 7 aa, synthetic construct
  REGION 1..7: note = n-mer motif
LAQGTDR

SEQ ID NO: 4369 - protein, 7 aa, synthetic construct
  REGION 1..7: note = n-mer motif
QSVSTGA

SEQ ID NO: 4370 - protein, 7 aa, synthetic construct
  REGION 1..7: note = n-mer motif
LTQVYHE

SEQ ID NO: 4371 - protein, 7 aa, synthetic construct
  REGION 1..7: note = n-mer motif
REMSSLS

SEQ ID NO: 4372 - protein, 7 aa, synthetic construct
  REGION 1..7: note = n-mer motif
TSTMTAR

SEQ ID NO: 4373 - protein, 7 aa, synthetic construct
  REGION 1..7: note = n-mer motif
TIQQVSN

SEQ ID NO: 4374 - protein, 7 aa, synthetic construct
  REGION 1..7: note = n-mer motif
RTQAGDS

SEQ ID NO: 4375 - protein, 7 aa, synthetic construct
  REGION 1..7: note = n-mer motif
NTYTAGK

SEQ ID NO: 4376 - protein, 7 aa, synthetic construct
  REGION 1..7: note = n-mer motif
NEQNTPS

SEQ ID NO: 4377 - protein, 7 aa, synthetic construct
  REGION 1..7: note = n-mer motif
GFAQQEA

SEQ ID NO: 4378 - protein, 7 aa, synthetic construct
  REGION 1..7: note = n-mer motif
SPQHGVI

SEQ ID NO: 4379 - protein, 7 aa, synthetic construct
  REGION 1..7: note = n-mer motif
AVHATSS

SEQ ID NO: 4380 - protein, 7 aa, synthetic construct
  REGION 1..7: note = n-mer motif
GDTRGAH

SEQ ID NO: 4381 - protein, 7 aa, synthetic construct
  REGION 1..7: note = n-mer motif
VRETTHL

SEQ ID NO: 4382 - protein, 7 aa, synthetic construct
  REGION 1..7: note = n-mer motif
LSQQRDY

SEQ ID NO: 4383 - protein, 7 aa, synthetic construct
  REGION 1..7: note = n-mer motif
ATRGESS

SEQ ID NO: 4384 - protein, 7 aa, synthetic construct
  REGION 1..7: note = n-mer motif
TNDSVGS

SEQ ID NO: 4385 - protein, 7 aa, synthetic construct
  REGION 1..7: note = n-mer motif
LTNNFKD

SEQ ID NO: 4386 - protein, 7 aa, synthetic construct
  REGION 1..7: note = n-mer motif
VNGTQIF

SEQ ID NO: 4387 - protein, 7 aa, synthetic construct
  REGION 1..7: note = n-mer motif
GNTGSPG

SEQ ID NO: 4388 - protein, 7 aa, synthetic construct
  REGION 1..7: note = n-mer motif
WTANQGL

SEQ ID NO: 4389 - protein, 7 aa, synthetic construct
  REGION 1..7: note = n-mer motif
NTTPTNH

SEQ ID NO: 4390 - protein, 7 aa, synthetic construct
  REGION 1..7: note = n-mer motif
ERVNGMA

SEQ ID NO: 4391 - protein, 7 aa, synthetic construct
  REGION 1..7: note = n-mer motif
KVTNNAY

SEQ ID NO: 4392 - protein, 7 aa, synthetic construct
  REGION 1..7: note = n-mer motif
LSSESPR

SEQ ID NO: 4393 - protein, 7 aa, synthetic construct
  REGION 1..7: note = n-mer motif
HTAAVAT

SEQ ID NO: 4394 - protein, 7 aa, synthetic construct
  REGION 1..7: note = n-mer motif
YDSRLYA

SEQ ID NO: 4395 - protein, 7 aa, synthetic construct
  REGION 1..7: note = n-mer motif
IEHMLRP

SEQ ID NO: 4396 - protein, 7 aa, synthetic construct
  REGION 1..7: note = n-mer motif
YLESNYT

SEQ ID NO: 4397 - protein, 7 aa, synthetic construct
  REGION 1..7: note = n-mer motif
AYSSTGH

SEQ ID NO: 4398 - protein, 7 aa, synthetic construct
  REGION 1..7: note = n-mer motif
IDISTQS

SEQ ID NO: 4399 - protein, 7 aa, synthetic construct
  REGION 1..7: note = n-mer motif
TTNSGAT

SEQ ID NO: 4400 - protein, 7 aa, synthetic construct
  REGION 1..7: note = n-mer motif
NVLTTVV

SEQ ID NO: 4401 - protein, 7 aa, synthetic construct
  REGION 1..7: note = n-mer motif
TTGIERS

SEQ ID NO: 4402 - protein, 7 aa, synthetic construct
  REGION 1..7: note = n-mer motif
ARVDTNQ

SEQ ID NO: 4403 - protein, 7 aa, synthetic construct
  REGION 1..7: note = n-mer motif
QSVKEAI

SEQ ID NO: 4404 - protein, 7 aa, synthetic construct
  REGION 1..7: note = n-mer motif
ALLSVNE

SEQ ID NO: 4405 - protein, 7 aa, synthetic construct
  REGION 1..7: note = n-mer motif
GRDNHHA

SEQ ID NO: 4406 - protein, 7 aa, synthetic construct
  REGION 1..7: note = n-mer motif
IQSQSQL

SEQ ID NO: 4407 - protein, 7 aa, synthetic construct
  REGION 1..7: note = n-mer motif
SEGSSRS

SEQ ID NO: 4408 - protein, 7 aa, synthetic construct
  REGION 1..7: note = n-mer motif
DVQNIRE

SEQ ID NO: 4409 - protein, 7 aa, synthetic construct
  REGION 1..7: note = n-mer motif
KGHAYEA

SEQ ID NO: 4410 - protein, 7 aa, synthetic construct
  REGION 1..7: note = n-mer motif
YVRAQDQ

SEQ ID NO: 4411 - protein, 7 aa, synthetic construct
  REGION 1..7: note = n-mer motif
VDEYRSR

SEQ ID NO: 4412 - protein, 7 aa, synthetic construct
  REGION 1..7: note = n-mer motif
TLSGYMR

SEQ ID NO: 4413 - protein, 7 aa, synthetic construct
  REGION 1..7: note = n-mer motif
PSVRLPL

SEQ ID NO: 4414 - protein, 7 aa, synthetic construct
  REGION 1..7: note = n-mer motif
NIAGGEQ

SEQ ID NO: 4415 - protein, 7 aa, synthetic construct
  REGION 1..7: note = n-mer motif
LLQSTYL

SEQ ID NO: 4416 - protein, 7 aa, synthetic construct
  REGION 1..7: note = n-mer motif
QSDTTSI

SEQ ID NO: 4417 - protein, 7 aa, synthetic construct
  REGION 1..7: note = n-mer motif
IRSGNAM

SEQ ID NO: 4418 - protein, 7 aa, synthetic construct
  REGION 1..7: note = n-mer motif
MLSQVLT

SEQ ID NO: 4419 - protein, 7 aa, synthetic construct
  REGION 1..7: note = n-mer motif
TERQIEL

SEQ ID NO: 4420 - protein, 7 aa, synthetic construct
  REGION 1..7: note = n-mer motif
GTHASAY

SEQ ID NO: 4421 - protein, 7 aa, synthetic construct
  REGION 1..7: note = n-mer motif
VESSYSR

SEQ ID NO: 4422 - protein, 7 aa, synthetic construct
  REGION 1..7: note = n-mer motif
GGNYHTK

SEQ ID NO: 4423 - protein, 7 aa, synthetic construct
  REGION 1..7: note = n-mer motif
PTSHQEP

SEQ ID NO: 4424 - protein, 7 aa, synthetic construct
  REGION 1..7: note = n-mer motif
TIIGVLP

SEQ ID NO: 4425 - protein, 7 aa, synthetic construct
  REGION 1..7: note = n-mer motif
SNSGSTL

SEQ ID NO: 4426 - protein, 7 aa, synthetic construct
  REGION 1..7: note = n-mer motif
SITTVAN

SEQ ID NO: 4427 - protein, 7 aa, synthetic construct
  REGION 1..7: note = n-mer motif
ASPAQTG

SEQ ID NO: 4428 - protein, 7 aa, synthetic construct
  REGION 1..7: note = n-mer motif
SLPSHSN

SEQ ID NO: 4429 - protein, 7 aa, synthetic construct
  REGION 1..7: note = n-mer motif
LHNAVGP

SEQ ID NO: 4430 - protein, 7 aa, synthetic construct
  REGION 1..7: note = n-mer motif
QAPPTAQ

SEQ ID NO: 4431 - protein, 7 aa, synthetic construct
  REGION 1..7: note = n-mer motif
PNTASNF

SEQ ID NO: 4432 - protein, 7 aa, synthetic construct
  REGION 1..7: note = n-mer motif
PSNSERF

SEQ ID NO: 4433 - protein, 7 aa, synthetic construct
  REGION 1..7: note = n-mer motif
ELHAQQP

SEQ ID NO: 4434 - protein, 7 aa, synthetic construct
  REGION 1..7: note = n-mer motif
GSYSDGS

SEQ ID NO: 4435 - protein, 7 aa, synthetic construct
  REGION 1..7: note = n-mer motif
YGVQANS

SEQ ID NO: 4436 - protein, 7 aa, synthetic construct
  REGION 1..7: note = n-mer motif
EVGKTTH

SEQ ID NO: 4437 - protein, 7 aa, synthetic construct
  REGION 1..7: note = n-mer motif
TSQGRSP

SEQ ID NO: 4438 - protein, 7 aa, synthetic construct
  REGION 1..7: note = n-mer motif
VEHVAHQ

SEQ ID NO: 4439 - protein, 7 aa, synthetic construct
  REGION 1..7: note = n-mer motif
IQSSYNR

SEQ ID NO: 4440 - protein, 7 aa, synthetic construct
  REGION 1..7: note = n-mer motif
TLSVTLG

SEQ ID NO: 4441 - protein, 7 aa, synthetic construct
  REGION 1..7: note = n-mer motif
RNEPVST

SEQ ID NO: 4442 - protein, 7 aa, synthetic construct
  REGION 1..7: note = n-mer motif
VIVGSNE

SEQ ID NO: 4443 - protein, 7 aa, synthetic construct
  REGION 1..7: note = n-mer motif
ELSTPMV

SEQ ID NO: 4444 - protein, 7 aa, synthetic construct
  REGION 1..7: note = n-mer motif
AYNDLRS

SEQ ID NO: 4445 - protein, 7 aa, synthetic construct
  REGION 1..7: note = n-mer motif
NANSGER

SEQ ID NO: 4446 - protein, 7 aa, synthetic construct
  REGION 1..7: note = n-mer motif
LSSQWTQ

SEQ ID NO: 4447 - protein, 7 aa, synthetic construct
  REGION 1..7: note = n-mer motif
INAGNYR

SEQ ID NO: 4448 - protein, 7 aa, synthetic construct
  REGION 1..7: note = n-mer motif
LRSSEAP

SEQ ID NO: 4449 - protein, 7 aa, synthetic construct
  REGION 1..7: note = n-mer motif
TSDTNAR

SEQ ID NO: 4450 - protein, 7 aa, synthetic construct
  REGION 1..7: note = n-mer motif
PNSPHGS

SEQ ID NO: 4451 - protein, 7 aa, synthetic construct
  REGION 1..7: note = n-mer motif
TQHLPST

SEQ ID NO: 4452 - protein, 7 aa, synthetic construct
  REGION 1..7: note = n-mer motif
VHGNAPA

SEQ ID NO: 4453 - protein, 7 aa, synthetic construct
  REGION 1..7: note = n-mer motif
SSQRDSV

SEQ ID NO: 4454 - protein, 7 aa, synthetic construct
  REGION 1..7: note = n-mer motif
PPSVDRK

SEQ ID NO: 4455 - protein, 7 aa, synthetic construct
  REGION 1..7: note = n-mer motif
ETLPYKS

SEQ ID NO: 4456 - protein, 7 aa, synthetic construct
  REGION 1..7: note = n-mer motif
HLSQANH

SEQ ID NO: 4457 - protein, 7 aa, synthetic construct
  REGION 1..7: note = n-mer motif
KPLNGTN

SEQ ID NO: 4458 - protein, 7 aa, synthetic construct
  REGION 1..7: note = n-mer motif
WQTNGMQ

SEQ ID NO: 4459 - protein, 7 aa, synthetic construct
  REGION 1..7: note = n-mer motif
TVNVHSD

SEQ ID NO: 4460 - protein, 7 aa, synthetic construct
  REGION 1..7: note = n-mer motif
TQYVVAP

SEQ ID NO: 4461 - protein, 7 aa, synthetic construct
  REGION 1..7: note = n-mer motif
NVDSSNV

SEQ ID NO: 4462 - protein, 7 aa, synthetic construct
  REGION 1..7: note = n-mer motif
NGYQLQI

SEQ ID NO: 4463 - protein, 7 aa, synthetic construct
  REGION 1..7: note = n-mer motif
EETRTRM

SEQ ID NO: 4464 - protein, 7 aa, synthetic construct
  REGION 1..7: note = n-mer motif
TSPASDR

SEQ ID NO: 4465 - protein, 7 aa, synthetic construct
  REGION 1..7: note = n-mer motif
HSGAGVL

SEQ ID NO: 4466 - protein, 7 aa, synthetic construct
  REGION 1..7: note = n-mer motif
AANPSTE

SEQ ID NO: 4467 - protein, 7 aa, synthetic construct
  REGION 1..7: note = n-mer motif
MLVQNTP

SEQ ID NO: 4468 - protein, 7 aa, synthetic construct
  REGION 1..7: note = n-mer motif
VQQNNIN

SEQ ID NO: 4469 - protein, 7 aa, synthetic construct
  REGION 1..7: note = n-mer motif
HDGYVPN

SEQ ID NO: 4470 - protein, 7 aa, synthetic construct
  REGION 1..7: note = n-mer motif
NSGNNPI

SEQ ID NO: 4471 - protein, 7 aa, synthetic construct
  REGION 1..7: note = n-mer motif
TDNPSYK

SEQ ID NO: 4472 - protein, 7 aa, synthetic construct
  REGION 1..7: note = n-mer motif
GGLSLSS

SEQ ID NO: 4473 - protein, 7 aa, synthetic construct
  REGION 1..7: note = n-mer motif
NNENTRN

SEQ ID NO: 4474 - protein, 7 aa, synthetic construct
  REGION 1..7: note = n-mer motif
KNNNSDS

SEQ ID NO: 4475 - protein, 7 aa, synthetic construct
  REGION 1..7: note = n-mer motif
KDEHLHY

SEQ ID NO: 4476 - protein, 7 aa, synthetic construct
  REGION 1..7: note = n-mer motif
NFTITEA

SEQ ID NO: 4477 - protein, 7 aa, synthetic construct
  REGION 1..7: note = n-mer motif
LNQNSVS

SEQ ID NO: 4478 - protein, 7 aa, synthetic construct
  REGION 1..7: note = n-mer motif
NSHVPNN

SEQ ID NO: 4479 - protein, 7 aa, synthetic construct
  REGION 1..7: note = n-mer motif
NSTHINS

SEQ ID NO: 4480 - protein, 7 aa, synthetic construct
  REGION 1..7: note = n-mer motif
HMSSYSS

SEQ ID NO: 4481 - protein, 7 aa, synthetic construct
  REGION 1..7: note = n-mer motif
NVPNGQG

SEQ ID NO: 4482 - protein, 7 aa, synthetic construct
  REGION 1..7: note = n-mer motif
NGPTGSA

SEQ ID NO: 4483 - protein, 7 aa, synthetic construct
  REGION 1..7: note = n-mer motif
KSNAGFG

SEQ ID NO: 4484 - protein, 7 aa, synthetic construct
  REGION 1..7: note = n-mer motif
AAALETI

SEQ ID NO: 4485 - protein, 7 aa, synthetic construct
  REGION 1..7: note = n-mer motif
NRQRDFE

SEQ ID NO: 4486 - protein, 7 aa, synthetic construct
  REGION 1..7: note = n-mer motif
GSGNEPG

SEQ ID NO: 4487 - protein, 7 aa, synthetic construct
  REGION 1..7: note = n-mer motif
VSVAVPA

SEQ ID NO: 4488 - protein, 7 aa, synthetic construct
  REGION 1..7: note = n-mer motif
HSNTHYE

SEQ ID NO: 4489 - protein, 7 aa, synthetic construct
  REGION 1..7: note = n-mer motif
PDRANDK

SEQ ID NO: 4490 - protein, 7 aa, synthetic construct
  REGION 1..7: note = n-mer motif
QVGALMV

SEQ ID NO: 4491 - protein, 7 aa, synthetic construct
  REGION 1..7: note = n-mer motif
LTPQGTS

SEQ ID NO: 4492 - protein, 7 aa, synthetic construct
  REGION 1..7: note = n-mer motif
LYDGKHV

SEQ ID NO: 4493 - protein, 7 aa, synthetic construct
  REGION 1..7: note = n-mer motif
LTESVRN

SEQ ID NO: 4494 - protein, 7 aa, synthetic construct
  REGION 1..7: note = n-mer motif
STYGNTY

SEQ ID NO: 4495 - protein, 7 aa, synthetic construct
  REGION 1..7: note = n-mer motif
NAISTNN

SEQ ID NO: 4496 - protein, 7 aa, synthetic construct
  REGION 1..7: note = n-mer motif
IAHVSTN

SEQ ID NO: 4497 - protein, 7 aa, synthetic construct
  REGION 1..7: note = n-mer motif
SEERTRA

SEQ ID NO: 4498 - protein, 7 aa, synthetic construct
  REGION 1..7: note = n-mer motif
RWSENNS

SEQ ID NO: 4499 - protein, 7 aa, synthetic construct
  REGION 1..7: note = n-mer motif
DGNNTTY

SEQ ID NO: 4500 - protein, 7 aa, synthetic construct
  REGION 1..7: note = n-mer motif
VTTVDSA

SEQ ID NO: 4501 - protein, 7 aa, synthetic construct
  REGION 1..7: note = n-mer motif
TVKQTSP

SEQ ID NO: 4502 - protein, 7 aa, synthetic construct
  REGION 1..7: note = n-mer motif
SIYLAST

SEQ ID NO: 4503 - protein, 7 aa, synthetic construct
  REGION 1..7: note = n-mer motif
TTRNEHS

SEQ ID NO: 4504 - protein, 7 aa, synthetic construct
  REGION 1..7: note = n-mer motif
SYDMHTN

SEQ ID NO: 4505 - protein, 7 aa, synthetic construct
  REGION 1..7: note = n-mer motif
VSTYLLA

SEQ ID NO: 4506 - protein, 7 aa, synthetic construct
  REGION 1..7: note = n-mer motif
GEQSHNQ

SEQ ID NO: 4507 - protein, 7 aa, synthetic construct
  REGION 1..7: note = n-mer motif
TANNHSP

SEQ ID NO: 4508 - protein, 7 aa, synthetic construct
  REGION 1..7: note = n-mer motif
QFHGTSE

SEQ ID NO: 4509 - protein, 7 aa, synthetic construct
  REGION 1..7: note = n-mer motif
NVLGASS

SEQ ID NO: 4510 - protein, 7 aa, synthetic construct
  REGION 1..7: note = n-mer motif
RDSTISR

SEQ ID NO: 4511 - protein, 7 aa, synthetic construct
  REGION 1..7: note = n-mer motif
VIGTSRD

SEQ ID NO: 4512 - protein, 7 aa, synthetic construct
  REGION 1..7: note = n-mer motif
NYEKEFV

SEQ ID NO: 4513 - protein, 7 aa, synthetic construct
  REGION 1..7: note = n-mer motif
MDQSHSR

SEQ ID NO: 4514 - protein, 7 aa, synthetic construct
  REGION 1..7: note = n-mer motif
NSQNPQG

SEQ ID NO: 4515 - protein, 7 aa, synthetic construct
  REGION 1..7: note = n-mer motif
HTGTDNR

SEQ ID NO: 4516 - protein, 7 aa, synthetic construct
  REGION 1..7: note = n-mer motif
YNTVDQR

SEQ ID NO: 4517 - protein, 7 aa, synthetic construct
  REGION 1..7: note = n-mer motif
KESLEDV

SEQ ID NO: 4518 - protein, 7 aa, synthetic construct
  REGION 1..7: note = n-mer motif
TANSTYV

SEQ ID NO: 4519 - protein, 7 aa, synthetic construct
  REGION 1..7: note = n-mer motif
YLNSTQI

SEQ ID NO: 4520 - protein, 7 aa, synthetic construct
  REGION 1..7: note = n-mer motif
RVEDTNS

SEQ ID NO: 4521 - protein, 7 aa, synthetic construct
  REGION 1..7: note = n-mer motif
NDARNRA

SEQ ID NO: 4522 - protein, 7 aa, synthetic construct
  REGION 1..7: note = n-mer motif
NTNNQEQ

SEQ ID NO: 4523 - protein, 7 aa, synthetic construct
  REGION 1..7: note = n-mer motif
TVGSNSI

SEQ ID NO: 4524 - protein, 7 aa, synthetic construct
  REGION 1..7: note = n-mer motif
YGERART

SEQ ID NO: 4525 - protein, 7 aa, synthetic construct
  REGION 1..7: note = n-mer motif
PTGGSPP

SEQ ID NO: 4526 - protein, 7 aa, synthetic construct
  REGION 1..7: note = n-mer motif
LGQVNST

SEQ ID NO: 4527 - protein, 7 aa, synthetic construct
  REGION 1..7: note = n-mer motif
VSGPVSV

SEQ ID NO: 4528 - protein, 7 aa, synthetic construct
  REGION 1..7: note = n-mer motif
GTNHDFS

SEQ ID NO: 4529 - protein, 7 aa, synthetic construct
  REGION 1..7: note = n-mer motif
KTLDNNA

SEQ ID NO: 4530 - protein, 7 aa, synthetic construct
  REGION 1..7: note = n-mer motif
HSELRQN

SEQ ID NO: 4531 - protein, 7 aa, synthetic construct
  REGION 1..7: note = n-mer motif
EKNLTNA

SEQ ID NO: 4532 - protein, 7 aa, synthetic construct
  REGION 1..7: note = n-mer motif
TGLGGNS

SEQ ID NO: 4533 - protein, 7 aa, synthetic construct
  REGION 1..7: note = n-mer motif
KDHILSL

SEQ ID NO: 4534 - protein, 7 aa, synthetic construct
  REGION 1..7: note = n-mer motif
ITTGGVL

SEQ ID NO: 4535 - protein, 7 aa, synthetic construct
  REGION 1..7: note = n-mer motif
LADSNSK

SEQ ID NO: 4536 - protein, 7 aa, synthetic construct
  REGION 1..7: note = n-mer motif
SISDKNQ

SEQ ID NO: 4537 - protein, 7 aa, synthetic construct
  REGION 1..7: note = n-mer motif
YIAGGEQ

SEQ ID NO: 4538 - protein, 7 aa, synthetic construct
  REGION 1..7: note = n-mer motif
LPDKGRI

SEQ ID NO: 4539 - protein, 7 aa, synthetic construct
  REGION 1..7: note = n-mer motif
LIQTQGT

SEQ ID NO: 4540 - protein, 7 aa, synthetic construct
  REGION 1..7: note = n-mer motif
YSGELNK

SEQ ID NO: 4541 - protein, 7 aa, synthetic construct
  REGION 1..7: note = n-mer motif
CASEVCQ

SEQ ID NO: 4542 - protein, 7 aa, synthetic construct
  REGION 1..7: note = n-mer motif
LMAANTA

SEQ ID NO: 4543 - protein, 7 aa, synthetic construct
  REGION 1..7: note = n-mer motif
HQSFDAG

SEQ ID NO: 4544 - protein, 7 aa, synthetic construct
  REGION 1..7: note = n-mer motif
GETLRSQ

SEQ ID NO: 4545 - protein, 7 aa, synthetic construct
  REGION 1..7: note = n-mer motif
QTDGPNF

SEQ ID NO: 4546 - protein, 7 aa, synthetic construct
  REGION 1..7: note = n-mer motif
TTTNVNF

SEQ ID NO: 4547 - protein, 7 aa, synthetic construct
  REGION 1..7: note = n-mer motif
NMTNENG

SEQ ID NO: 4548 - protein, 7 aa, synthetic construct
  REGION 1..7: note = n-mer motif
GYSPSTP

SEQ ID NO: 4549 - protein, 7 aa, synthetic construct
  REGION 1..7: note = n-mer motif
LQVTVHN

SEQ ID NO: 4550 - protein, 7 aa, synthetic construct
  REGION 1..7: note = n-mer motif
DLTHVHR

SEQ ID NO: 4551 - protein, 7 aa, synthetic construct
  REGION 1..7: note = n-mer motif
TELSEYT

SEQ ID NO: 4552 - protein, 7 aa, synthetic construct
  REGION 1..7: note = n-mer motif
MTVASTS

SEQ ID NO: 4553 - protein, 7 aa, synthetic construct
  REGION 1..7: note = n-mer motif
SSQAHGP

SEQ ID NO: 4554 - protein, 7 aa, synthetic construct
  REGION 1..7: note = n-mer motif
TRSPNED

SEQ ID NO: 4555 - protein, 7 aa, synthetic construct
  REGION 1..7: note = n-mer motif
DNNKHGT

SEQ ID NO: 4556 - protein, 7 aa, synthetic construct
  REGION 1..7: note = n-mer motif
REIVHSN

SEQ ID NO: 4557 - protein, 7 aa, synthetic construct
  REGION 1..7: note = n-mer motif
RKLELDL

SEQ ID NO: 4558 - protein, 7 aa, synthetic construct
  REGION 1..7: note = n-mer motif
IYETVTL

SEQ ID NO: 4559 - protein, 7 aa, synthetic construct
  REGION 1..7: note = n-mer motif
NSGSTSF

SEQ ID NO: 4560 - protein, 7 aa, synthetic construct
  REGION 1..7: note = n-mer motif
PSTNESR

SEQ ID NO: 4561 - protein, 7 aa, synthetic construct
  REGION 1..7: note = n-mer motif
QADLRYK

SEQ ID NO: 4562 - protein, 7 aa, synthetic construct
  REGION 1..7: note = n-mer motif
DQPGYVR

SEQ ID NO: 4563 - protein, 7 aa, synthetic construct
  REGION 1..7: note = n-mer motif
DAMLAHP

SEQ ID NO: 4564 - protein, 7 aa, synthetic construct
  REGION 1..7: note = n-mer motif
TRHDGST

SEQ ID NO: 4565 - protein, 7 aa, synthetic construct
  REGION 1..7: note = n-mer motif
LANMSAP

SEQ ID NO: 4566 - protein, 7 aa, synthetic construct
  REGION 1..7: note = n-mer motif
TGHPPAA

SEQ ID NO: 4567 - protein, 7 aa, synthetic construct
  REGION 1..7: note = n-mer motif
SSISLRY

SEQ ID NO: 4568 - protein, 7 aa, synthetic construct
  REGION 1..7: note = n-mer motif
MHVDKTS

SEQ ID NO: 4569 - protein, 7 aa, synthetic construct
  REGION 1..7: note = n-mer motif
GSDSKHP

SEQ ID NO: 4570 - protein, 7 aa, synthetic construct
  REGION 1..7: note = n-mer motif
GESSSIS

SEQ ID NO: 4571 - protein, 7 aa, synthetic construct
  REGION 1..7: note = n-mer motif
VVHSHSE

SEQ ID NO: 4572 - protein, 7 aa, synthetic construct
  REGION 1..7: note = n-mer motif
SVRAHVL

SEQ ID NO: 4573 - protein, 7 aa, synthetic construct
  REGION 1..7: note = n-mer motif
ADGAKSA

SEQ ID NO: 4574 - protein, 7 aa, synthetic construct
  REGION 1..7: note = n-mer motif
GEARREA

SEQ ID NO: 4575 - protein, 7 aa, synthetic construct
  REGION 1..7: note = n-mer motif
FNATVVH

SEQ ID NO: 4576 - protein, 7 aa, synthetic construct
  REGION 1..7: note = n-mer motif
WTEGGSG

SEQ ID NO: 4577 - protein, 7 aa, synthetic construct
  REGION 1..7: note = n-mer motif
DSSYTHP

SEQ ID NO: 4578 - protein, 7 aa, synthetic construct
  REGION 1..7: note = n-mer motif
FPSRDNV

SEQ ID NO: 4579 - protein, 7 aa, synthetic construct
  REGION 1..7: note = n-mer motif
AITHIGT

SEQ ID NO: 4580 - protein, 7 aa, synthetic construct
  REGION 1..7: note = n-mer motif
AFKSGSI

SEQ ID NO: 4581 - protein, 7 aa, synthetic construct
  REGION 1..7: note = n-mer motif
MSNASYI

SEQ ID NO: 4582 - protein, 7 aa, synthetic construct
  REGION 1..7: note = n-mer motif
AERNDRT

SEQ ID NO: 4583 - protein, 7 aa, synthetic construct
  REGION 1..7: note = n-mer motif
TLETTRS

SEQ ID NO: 4584 - protein, 7 aa, synthetic construct
  REGION 1..7: note = n-mer motif
RLHGSDS

SEQ ID NO: 4585 - protein, 7 aa, synthetic construct
  REGION 1..7: note = n-mer motif
YEGHMNT

SEQ ID NO: 4586 - protein, 7 aa, synthetic construct
  REGION 1..7: note = n-mer motif
SVTTNLM

SEQ ID NO: 4587 - protein, 7 aa, synthetic construct
  REGION 1..7: note = n-mer motif
LRDQTSM

SEQ ID NO: 4588 - protein, 7 aa, synthetic construct
  REGION 1..7: note = n-mer motif
PASHSAG

SEQ ID NO: 4589 - protein, 7 aa, synthetic construct
  REGION 1..7: note = n-mer motif
VVENLRQ

SEQ ID NO: 4590 - protein, 7 aa, synthetic construct
  REGION 1..7: note = n-mer motif
QQSQNSI

SEQ ID NO: 4591 - protein, 7 aa, synthetic construct
  REGION 1..7: note = n-mer motif
LVDTDRN

SEQ ID NO: 4592 - protein, 7 aa, synthetic construct
  REGION 1..7: note = n-mer motif
NEMGNYV

SEQ ID NO: 4593 - protein, 7 aa, synthetic construct
  REGION 1..7: note = n-mer motif
STDPRYS

SEQ ID NO: 4594 - protein, 7 aa, synthetic construct
  REGION 1..7: note = n-mer motif
TNGIYQP

SEQ ID NO: 4595 - protein, 7 aa, synthetic construct
  REGION 1..7: note = n-mer motif
WVNSVGN

SEQ ID NO: 4596 - protein, 7 aa, synthetic construct
  REGION 1..7: note = n-mer motif
GVSNNSS

SEQ ID NO: 4597 - protein, 7 aa, synthetic construct
  REGION 1..7: note = n-mer motif
NVNAQSR

SEQ ID NO: 4598 - protein, 7 aa, synthetic construct
  REGION 1..7: note = n-mer motif
TTPPFSN

SEQ ID NO: 4599 - protein, 7 aa, synthetic construct
  REGION 1..7: note = n-mer motif
TGSSHTN

SEQ ID NO: 4600 - protein, 7 aa, synthetic construct
  REGION 1..7: note = n-mer motif
YVDKSMT

SEQ ID NO: 4601 - protein, 7 aa, synthetic construct
  REGION 1..7: note = n-mer motif
LIKNNML

SEQ ID NO: 4602 - protein, 7 aa, synthetic construct
  REGION 1..7: note = n-mer motif
GGTGLSK

SEQ ID NO: 4603 - protein, 7 aa, synthetic construct
  REGION 1..7: note = n-mer motif
ALHNLMN

SEQ ID NO: 4604 - protein, 7 aa, synthetic construct
  REGION 1..7: note = n-mer motif
VHVTNVL

SEQ ID NO: 4605 - protein, 7 aa, synthetic construct
  REGION 1..7: note = n-mer motif
STTHPSE

SEQ ID NO: 4606 - protein, 7 aa, synthetic construct
  REGION 1..7: note = n-mer motif
SVGSPTH

SEQ ID NO: 4607 - protein, 7 aa, synthetic construct
  REGION 1..7: note = n-mer motif
MSNDLPG

SEQ ID NO: 4608 - protein, 7 aa, synthetic construct
  REGION 1..7: note = n-mer motif
FSSTEAR

SEQ ID NO: 4609 - protein, 7 aa, synthetic construct
  REGION 1..7: note = n-mer motif
AGHQQLA

SEQ ID NO: 4610 - protein, 7 aa, synthetic construct
  REGION 1..7: note = n-mer motif
GTILPNQ

SEQ ID NO: 4611 - protein, 7 aa, synthetic construct
  REGION 1..7: note = n-mer motif
SAVSGSS

SEQ ID NO: 4612 - protein, 7 aa, synthetic construct
  REGION 1..7: note = n-mer motif
EVSRDGL

SEQ ID NO: 4613 - protein, 7 aa, synthetic construct
  REGION 1..7: note = n-mer motif
QSLKDGT

SEQ ID NO: 4614 - protein, 7 aa, synthetic construct
  REGION 1..7: note = n-mer motif
TREGNHA

SEQ ID NO: 4615 - protein, 7 aa, synthetic construct
  REGION 1..7: note = n-mer motif
VATQNLL

SEQ ID NO: 4616 - protein, 7 aa, synthetic construct
  REGION 1..7: note = n-mer motif
AEMTHRL

SEQ ID NO: 4617 - protein, 7 aa, synthetic construct
  REGION 1..7: note = n-mer motif
QRPDPLK

SEQ ID NO: 4618 - protein, 7 aa, synthetic construct
  REGION 1..7: note = n-mer motif
EHISSYG

SEQ ID NO: 4619 - protein, 7 aa, synthetic construct
  REGION 1..7: note = n-mer motif
QKSNDQN

SEQ ID NO: 4620 - protein, 7 aa, synthetic construct
  REGION 1..7: note = n-mer motif
NLVMSGT

SEQ ID NO: 4621 - protein, 7 aa, synthetic construct
  REGION 1..7: note = n-mer motif
GAGQSHV

SEQ ID NO: 4622 - protein, 7 aa, synthetic construct
  REGION 1..7: note = n-mer motif
LNHTMPL

SEQ ID NO: 4623 - protein, 7 aa, synthetic construct
  REGION 1..7: note = n-mer motif
VSQSHDV

SEQ ID NO: 4624 - protein, 7 aa, synthetic construct
  REGION 1..7: note = n-mer motif
ANSATNQ

SEQ ID NO: 4625 - protein, 7 aa, synthetic construct
  REGION 1..7: note = n-mer motif
GTGGNRE

SEQ ID NO: 4626 - protein, 7 aa, synthetic construct
  REGION 1..7: note = n-mer motif
AKSSIIL

SEQ ID NO: 4627 - protein, 7 aa, synthetic construct
  REGION 1..7: note = n-mer motif
GGTALGS

SEQ ID NO: 4628 - protein, 7 aa, synthetic construct
  REGION 1..7: note = n-mer motif
NKVESDP

SEQ ID NO: 4629 - protein, 7 aa, synthetic construct
  REGION 1..7: note = n-mer motif
NSKQPDV

SEQ ID NO: 4630 - protein, 7 aa, synthetic construct
  REGION 1..7: note = n-mer motif
SYADRRL

SEQ ID NO: 4631 - protein, 7 aa, synthetic construct
  REGION 1..7: note = n-mer motif
NVNPNGP

SEQ ID NO: 4632 - protein, 7 aa, synthetic construct
  REGION 1..7: note = n-mer motif
EHNSKTY

SEQ ID NO: 4633 - protein, 7 aa, synthetic construct
  REGION 1..7: note = n-mer motif
TQGSNTT

SEQ ID NO: 4634 - protein, 7 aa, synthetic construct
  REGION 1..7: note = n-mer motif
SNVSAYA

SEQ ID NO: 4635 - protein, 7 aa, synthetic construct
  REGION 1..7: note = n-mer motif
AYSDSAR

SEQ ID NO: 4636 - protein, 7 aa, synthetic construct
  REGION 1..7: note = n-mer motif
GSQYANR

SEQ ID NO: 4637 - protein, 7 aa, synthetic construct
  REGION 1..7: note = n-mer motif
TMSVTLE

SEQ ID NO: 4638 - protein, 7 aa, synthetic construct
  REGION 1..7: note = n-mer motif
QTTILAA

SEQ ID NO: 4639 - protein, 7 aa, synthetic construct
  REGION 1..7: note = n-mer motif
LLQSIVV

SEQ ID NO: 4640 - protein, 7 aa, synthetic construct
  REGION 1..7: note = n-mer motif
VHANATL

SEQ ID NO: 4641 - protein, 7 aa, synthetic construct
  REGION 1..7: note = n-mer motif
NKTNADY

SEQ ID NO: 4642 - protein, 7 aa, synthetic construct
  REGION 1..7: note = n-mer motif
NYDTGAK

SEQ ID NO: 4643 - protein, 7 aa, synthetic construct
  REGION 1..7: note = n-mer motif
VYHNRDV

SEQ ID NO: 4644 - protein, 7 aa, synthetic construct
  REGION 1..7: note = n-mer motif
DSAPRSI

SEQ ID NO: 4645 - protein, 7 aa, synthetic construct
  REGION 1..7: note = n-mer motif
LIANLSN

SEQ ID NO: 4646 - protein, 7 aa, synthetic construct
  REGION 1..7: note = n-mer motif
PQDVRQT

SEQ ID NO: 4647 - protein, 7 aa, synthetic construct
  REGION 1..7: note = n-mer motif
TMTAIAM

SEQ ID NO: 4648 - protein, 7 aa, synthetic construct
  REGION 1..7: note = n-mer motif
TYASTEA

SEQ ID NO: 4649 - protein, 7 aa, synthetic construct
  REGION 1..7: note = n-mer motif
PHANGVT

SEQ ID NO: 4650 - protein, 7 aa, synthetic construct
  REGION 1..7: note = n-mer motif
RADVSWS

SEQ ID NO: 4651 - protein, 7 aa, synthetic construct
  REGION 1..7: note = n-mer motif
LTHMTGT

SEQ ID NO: 4652 - protein, 7 aa, synthetic construct
  REGION 1..7: note = n-mer motif
ANDSAKT

SEQ ID NO: 4653 - protein, 7 aa, synthetic construct
  REGION 1..7: note = n-mer motif
ANSGLHN

SEQ ID NO: 4654 - protein, 7 aa, synthetic construct
  REGION 1..7: note = n-mer motif
NVGTDRD

SEQ ID NO: 4655 - protein, 7 aa, synthetic construct
  REGION 1..7: note = n-mer motif
VGTTSNG

SEQ ID NO: 4656 - protein, 7 aa, synthetic construct
  REGION 1..7: note = n-mer motif
GVLGILV

SEQ ID NO: 4657 - protein, 7 aa, synthetic construct
  REGION 1..7: note = n-mer motif
RINAAID

SEQ ID NO: 4658 - protein, 7 aa, synthetic construct
  REGION 1..7: note = n-mer motif
PDTRPSI

SEQ ID NO: 4659 - protein, 7 aa, synthetic construct
  REGION 1..7: note = n-mer motif
GESRTNM

SEQ ID NO: 4660 - protein, 7 aa, synthetic construct
  REGION 1..7: note = n-mer motif
ILLAQSA

SEQ ID NO: 4661 - protein, 7 aa, synthetic construct
  REGION 1..7: note = n-mer motif
YNRDNGS

SEQ ID NO: 4662 - protein, 7 aa, synthetic construct
  REGION 1..7: note = n-mer motif
WNSPGEA

SEQ ID NO: 4663 - protein, 7 aa, synthetic construct
  REGION 1..7: note = n-mer motif
LLGAHQP

SEQ ID NO: 4664 - protein, 7 aa, synthetic construct
  REGION 1..7: note = n-mer motif
IGKDSVP

SEQ ID NO: 4665 - protein, 7 aa, synthetic construct
  REGION 1..7: note = n-mer motif
TRESLVD

SEQ ID NO: 4666 - protein, 7 aa, synthetic construct
  REGION 1..7: note = n-mer motif
ASNHLQA

SEQ ID NO: 4667 - protein, 7 aa, synthetic construct
  REGION 1..7: note = n-mer motif
NLQTGKA

SEQ ID NO: 4668 - protein, 7 aa, synthetic construct
  REGION 1..7: note = n-mer motif
TVGSSYA

SEQ ID NO: 4669 - protein, 7 aa, synthetic construct
  REGION 1..7: note = n-mer motif
DTNGIKS

SEQ ID NO: 4670 - protein, 7 aa, synthetic construct
  REGION 1..7: note = n-mer motif
SLRMENS

SEQ ID NO: 4671 - protein, 7 aa, synthetic construct
  REGION 1..7: note = n-mer motif
TKGNNLV

SEQ ID NO: 4672 - protein, 7 aa, synthetic construct
  REGION 1..7: note = n-mer motif
HTNQMQP

SEQ ID NO: 4673 - protein, 7 aa, synthetic construct
  REGION 1..7: note = n-mer motif
NGNYDGA

SEQ ID NO: 4674 - protein, 7 aa, synthetic construct
  REGION 1..7: note = n-mer motif
EAHNRGN

SEQ ID NO: 4675 - protein, 7 aa, synthetic construct
  REGION 1..7: note = n-mer motif
GTVNSSA

SEQ ID NO: 4676 - protein, 7 aa, synthetic construct
  REGION 1..7: note = n-mer motif
GPTMNHN

SEQ ID NO: 4677 - protein, 7 aa, synthetic construct
  REGION 1..7: note = n-mer motif
VPNNNTS

SEQ ID NO: 4678 - protein, 7 aa, synthetic construct
  REGION 1..7: note = n-mer motif
VSNKSGS

SEQ ID NO: 4679 - protein, 7 aa, synthetic construct
  REGION 1..7: note = n-mer motif
WGVSNSA

SEQ ID NO: 4680 - protein, 7 aa, synthetic construct
  REGION 1..7: note = n-mer motif
VSNVLYS

SEQ ID NO: 4681 - protein, 7 aa, synthetic construct
  REGION 1..7: note = n-mer motif
AGQNSVG

SEQ ID NO: 4682 - protein, 7 aa, synthetic construct
  REGION 1..7: note = n-mer motif
GTSLENR

SEQ ID NO: 4683 - protein, 7 aa, synthetic construct
  REGION 1..7: note = n-mer motif
QMNIHDK

SEQ ID NO: 4684 - protein, 7 aa, synthetic construct
  REGION 1..7: note = n-mer motif
PQLSGTA

SEQ ID NO: 4685 - protein, 7 aa, synthetic construct
  REGION 1..7: note = n-mer motif
SSTPQDT

SEQ ID NO: 4686 - protein, 7 aa, synthetic construct
  REGION 1..7: note = n-mer motif
VQGQTGW

SEQ ID NO: 4687 - protein, 7 aa, synthetic construct
  REGION 1..7: note = n-mer motif
GLTGDLV

SEQ ID NO: 4688 - protein, 7 aa, synthetic construct
  REGION 1..7: note = n-mer motif
NHPAPSS

SEQ ID NO: 4689 - protein, 7 aa, synthetic construct
  REGION 1..7: note = n-mer motif
KEKTTRE

SEQ ID NO: 4690 - protein, 7 aa, synthetic construct
  REGION 1..7: note = n-mer motif
TTNPQTQ

SEQ ID NO: 4691 - protein, 7 aa, synthetic construct
  REGION 1..7: note = n-mer motif
GGEHARN

SEQ ID NO: 4692 - protein, 7 aa, synthetic construct
  REGION 1..7: note = n-mer motif
TTEAVVA

SEQ ID NO: 4693 - protein, 7 aa, synthetic construct
  REGION 1..7: note = n-mer motif
QNSDLAS

SEQ ID NO: 4694 - protein, 7 aa, synthetic construct
  REGION 1..7: note = n-mer motif
YSTEARV

SEQ ID NO: 4695 - protein, 7 aa, synthetic construct
  REGION 1..7: note = n-mer motif
TGQAGGS

SEQ ID NO: 4696 - protein, 7 aa, synthetic construct
  REGION 1..7: note = n-mer motif
TSSNLYV

SEQ ID NO: 4697 - protein, 7 aa, synthetic construct
  REGION 1..7: note = n-mer motif
TARAIDM

SEQ ID NO: 4698 - protein, 7 aa, synthetic construct
  REGION 1..7: note = n-mer motif
QESNRGV

SEQ ID NO: 4699 - protein, 7 aa, synthetic construct
  REGION 1..7: note = n-mer motif
SIGFSVG

SEQ ID NO: 4700 - protein, 7 aa, synthetic construct
  REGION 1..7: note = n-mer motif
ERSTHNV

SEQ ID NO: 4701 - protein, 7 aa, synthetic construct
  REGION 1..7: note = n-mer motif
ANHDNIV

SEQ ID NO: 4702 - protein, 7 aa, synthetic construct
  REGION 1..7: note = n-mer motif
WAMNNVP

SEQ ID NO: 4703 - protein, 7 aa, synthetic construct
  REGION 1..7: note = n-mer motif
YIAAGEQ

SEQ ID NO: 4704 - protein, 7 aa, synthetic construct
  REGION 1..7: note = n-mer motif
SSNTSGS

SEQ ID NO: 4705 - protein, 7 aa, synthetic construct
  REGION 1..7: note = n-mer motif
MGKHEGL

SEQ ID NO: 4706 - protein, 7 aa, synthetic construct
  REGION 1..7: note = n-mer motif
VLTHLPT

SEQ ID NO: 4707 - protein, 7 aa, synthetic construct
  REGION 1..7: note = n-mer motif
EMGNQYP

SEQ ID NO: 4708 - protein, 7 aa, synthetic construct
  REGION 1..7: note = n-mer motif
SLRPTLP

SEQ ID NO: 4709 - protein, 7 aa, synthetic construct
  REGION 1..7: note = n-mer motif
SANLYKQ

SEQ ID NO: 4710 - protein, 7 aa, synthetic construct
  REGION 1..7: note = n-mer motif
QNDRKPD

SEQ ID NO: 4711 - protein, 7 aa, synthetic construct
  REGION 1..7: note = n-mer motif
IISGITV

SEQ ID NO: 4712 - protein, 7 aa, synthetic construct
  REGION 1..7: note = n-mer motif
PSEMRAV

SEQ ID NO: 4713 - protein, 7 aa, synthetic construct
  REGION 1..7: note = n-mer motif
LVTQTPN

SEQ ID NO: 4714 - protein, 7 aa, synthetic construct
  REGION 1..7: note = n-mer motif
IAQNETY

SEQ ID NO: 4715 - protein, 7 aa, synthetic construct
  REGION 1..7: note = n-mer motif
PYLRNMA

SEQ ID NO: 4716 - protein, 7 aa, synthetic construct
  REGION 1..7: note = n-mer motif
GVNTKIE

SEQ ID NO: 4717 - protein, 7 aa, synthetic construct
  REGION 1..7: note = n-mer motif
YSSEMSE

SEQ ID NO: 4718 - protein, 7 aa, synthetic construct
  REGION 1..7: note = n-mer motif
LENPTPA

SEQ ID NO: 4719 - protein, 7 aa, synthetic construct
  REGION 1..7: note = n-mer motif
GVMSNAT

SEQ ID NO: 4720 - protein, 7 aa, synthetic construct
  REGION 1..7: note = n-mer motif
AHTALAG

SEQ ID NO: 4721 - protein, 7 aa, synthetic construct
  REGION 1..7: note = n-mer motif
PVVRDRS

SEQ ID NO: 4722 - protein, 7 aa, synthetic construct
  REGION 1..7: note = n-mer motif
SAGMVSL

SEQ ID NO: 4723 - protein, 7 aa, synthetic construct
  REGION 1..7: note = n-mer motif
SGVNSER

SEQ ID NO: 4724 - protein, 7 aa, synthetic construct
  REGION 1..7: note = n-mer motif
NGDVTNM

SEQ ID NO: 4725 - protein, 7 aa, synthetic construct
  REGION 1..7: note = n-mer motif
SVVPTDK

SEQ ID NO: 4726 - protein, 7 aa, synthetic construct
  REGION 1..7: note = n-mer motif
SKGDQLN

SEQ ID NO: 4727 - protein, 7 aa, synthetic construct
  REGION 1..7: note = n-mer motif
DGESRLS

SEQ ID NO: 4728 - protein, 7 aa, synthetic construct
  REGION 1..7: note = n-mer motif
GNMNHSI

SEQ ID NO: 4729 - protein, 7 aa, synthetic construct
  REGION 1..7: note = n-mer motif
SGHASQG

SEQ ID NO: 4730 - protein, 7 aa, synthetic construct
  REGION 1..7: note = n-mer motif
GWSNNEL

SEQ ID NO: 4731 - protein, 7 aa, synthetic construct
  REGION 1..7: note = n-mer motif
GVHTHTV

SEQ ID NO: 4732 - protein, 7 aa, synthetic construct
  REGION 1..7: note = n-mer motif
HVTVTLN

SEQ ID NO: 4733 - protein, 7 aa, synthetic construct
  REGION 1..7: note = n-mer motif
TRGNDIS

SEQ ID NO: 4734 - protein, 7 aa, synthetic construct
  REGION 1..7: note = n-mer motif
SKGGDMV

SEQ ID NO: 4735 - protein, 7 aa, synthetic construct
  REGION 1..7: note = n-mer motif
THGDHIQ

SEQ ID NO: 4736 - protein, 7 aa, synthetic construct
  REGION 1..7: note = n-mer motif
TTNSHAI

SEQ ID NO: 4737 - protein, 7 aa, synthetic construct
  REGION 1..7: note = n-mer motif
VRTVLQQ

SEQ ID NO: 4738 - protein, 7 aa, synthetic construct
  REGION 1..7: note = n-mer motif
TVRSPQP

SEQ ID NO: 4739 - protein, 7 aa, synthetic construct
  REGION 1..7: note = n-mer motif
NTYTAGK

SEQ ID NO: 4740 - protein, 7 aa, synthetic construct
  REGION 1..7: note = n-mer motif
ISNPENT

SEQ ID NO: 4741 - protein, 7 aa, synthetic construct
  REGION 1..7: note = n-mer motif
IGSPLAN

SEQ ID NO: 4742 - protein, 7 aa, synthetic construct
  REGION 1..7: note = n-mer motif
YTGTLVV

SEQ ID NO: 4743 - protein, 7 aa, synthetic construct
  REGION 1..7: note = n-mer motif
GRHTLAD

SEQ ID NO: 4744 - protein, 7 aa, synthetic construct
  REGION 1..7: note = n-mer motif
TDGPRLA

SEQ ID NO: 4745 - protein, 7 aa, synthetic construct
  REGION 1..7: note = n-mer motif
GAGNLGT

SEQ ID NO: 4746 - protein, 7 aa, synthetic construct
  REGION 1..7: note = n-mer motif
LMNRNAP

SEQ ID NO: 4747 - protein, 7 aa, synthetic construct
  REGION 1..7: note = n-mer motif
NAMASSR

SEQ ID NO: 4748 - protein, 7 aa, synthetic construct
  REGION 1..7: note = n-mer motif
QHRAQDV

SEQ ID NO: 4749 - protein, 7 aa, synthetic construct
  REGION 1..7: note = n-mer motif
KIESGTI

SEQ ID NO: 4750 - protein, 7 aa, synthetic construct
  REGION 1..7: note = n-mer motif
TNYPEAN

SEQ ID NO: 4751 - protein, 7 aa, synthetic construct
  REGION 1..7: note = n-mer motif
VYHGVAS

SEQ ID NO: 4752 - protein, 7 aa, synthetic construct
  REGION 1..7: note = n-mer motif
SNVHVVN

SEQ ID NO: 4753 - protein, 7 aa, synthetic construct
  REGION 1..7: note = n-mer motif
TYTDGNP

SEQ ID NO: 4754 - protein, 7 aa, synthetic construct
  REGION 1..7: note = n-mer motif
FIANTNP

SEQ ID NO: 4755 - protein, 7 aa, synthetic construct
  REGION 1..7: note = n-mer motif
DAGYGHD

SEQ ID NO: 4756 - protein, 7 aa, synthetic construct
  REGION 1..7: note = n-mer motif
GLSRNDG

SEQ ID NO: 4757 - protein, 7 aa, synthetic construct
  REGION 1..7: note = n-mer motif
MMGATTK

SEQ ID NO: 4758 - protein, 7 aa, synthetic construct
  REGION 1..7: note = n-mer motif
PINVLTT

SEQ ID NO: 4759 - protein, 7 aa, synthetic construct
  REGION 1..7: note = n-mer motif
AVDQSRL

SEQ ID NO: 4760 - protein, 7 aa, synthetic construct
  REGION 1..7: note = n-mer motif
NASTYMD

SEQ ID NO: 4761 - protein, 7 aa, synthetic construct
  REGION 1..7: note = n-mer motif
TQAGLAS

SEQ ID NO: 4762 - protein, 7 aa, synthetic construct
  REGION 1..7: note = n-mer motif
AQFESGR

SEQ ID NO: 4763 - protein, 7 aa, synthetic construct
  REGION 1..7: note = n-mer motif
RNGGTTD

SEQ ID NO: 4764 - protein, 7 aa, synthetic construct
  REGION 1..7: note = n-mer motif
ANTYNVQ

SEQ ID NO: 4765 - protein, 7 aa, synthetic construct
  REGION 1..7: note = n-mer motif
SGVHSER

SEQ ID NO: 4766 - protein, 7 aa, synthetic construct
  REGION 1..7: note = n-mer motif
NTGTTSV

SEQ ID NO: 4767 - protein, 7 aa, synthetic construct
  REGION 1..7: note = n-mer motif
STSNSHM

SEQ ID NO: 4768 - protein, 7 aa, synthetic construct
  REGION 1..7: note = n-mer motif
GEQHNAP

SEQ ID NO: 4769 - protein, 7 aa, synthetic construct
  REGION 1..7: note = n-mer motif
AHHMTTE

SEQ ID NO: 4770 - protein, 7 aa, synthetic construct
  REGION 1..7: note = n-mer motif
LMTGTAS

SEQ ID NO: 4771 - protein, 7 aa, synthetic construct
  REGION 1..7: note = n-mer motif
AAGADSP

SEQ ID NO: 4772 - protein, 7 aa, synthetic construct
  REGION 1..7: note = n-mer motif
VSLSSPP

SEQ ID NO: 4773 - protein, 7 aa, synthetic construct
  REGION 1..7: note = n-mer motif
RVVAGPN

SEQ ID NO: 4774 - protein, 7 aa, synthetic construct
  REGION 1..7: note = n-mer motif
DKTEMLQ

SEQ ID NO: 4775 - protein, 7 aa, synthetic construct
  REGION 1..7: note = n-mer motif
ARDDTIQ

SEQ ID NO: 4776 - protein, 7 aa, synthetic construct
  REGION 1..7: note = n-mer motif
LHLGLSS

SEQ ID NO: 4777 - protein, 7 aa, synthetic construct
  REGION 1..7: note = n-mer motif
LEGQRDV

SEQ ID NO: 4778 - protein, 7 aa, synthetic construct
  REGION 1..7: note = n-mer motif
ASLSAPA

SEQ ID NO: 4779 - protein, 7 aa, synthetic construct
  REGION 1..7: note = n-mer motif
SNPGNHN

SEQ ID NO: 4780 - protein, 7 aa, synthetic construct
  REGION 1..7: note = n-mer motif
GLNSKGT

SEQ ID NO: 4781 - protein, 7 aa, synthetic construct
  REGION 1..7: note = n-mer motif
KTPSASE

SEQ ID NO: 4782 - protein, 7 aa, synthetic construct
  REGION 1..7: note = n-mer motif
VLASTEK

SEQ ID NO: 4783 - protein, 7 aa, synthetic construct
  REGION 1..7: note = n-mer motif
SVLNKPT

SEQ ID NO: 4784 - protein, 7 aa, synthetic construct
  REGION 1..7: note = n-mer motif
PGNGQSP

SEQ ID NO: 4785 - protein, 7 aa, synthetic construct
  REGION 1..7: note = n-mer motif
ILMGART

SEQ ID NO: 4786 - protein, 7 aa, synthetic construct
  REGION 1..7: note = n-mer motif
ALPSHSS

SEQ ID NO: 4787 - protein, 7 aa, synthetic construct
  REGION 1..7: note = n-mer motif
RDQTHPN

SEQ ID NO: 4788 - protein, 7 aa, synthetic construct
  REGION 1..7: note = n-mer motif
SGPIPAV

SEQ ID NO: 4789 - protein, 7 aa, synthetic construct
  REGION 1..7: note = n-mer motif
YVDDNSR

SEQ ID NO: 4790 - protein, 7 aa, synthetic construct
  REGION 1..7: note = n-mer motif
LTRGVAA

SEQ ID NO: 4791 - protein, 7 aa, synthetic construct
  REGION 1..7: note = n-mer motif
SEKEARL

SEQ ID NO: 4792 - protein, 7 aa, synthetic construct
  REGION 1..7: note = n-mer motif
STTPPFK

SEQ ID NO: 4793 - protein, 7 aa, synthetic construct
  REGION 1..7: note = n-mer motif
YSTTMLN

SEQ ID NO: 4794 - protein, 7 aa, synthetic construct
  REGION 1..7: note = n-mer motif
KNGVIND

SEQ ID NO: 4795 - protein, 7 aa, synthetic construct
  REGION 1..7: note = n-mer motif
FGIGHGT

SEQ ID NO: 4796 - protein, 7 aa, synthetic construct
  REGION 1..7: note = n-mer motif
PLHVASP

SEQ ID NO: 4797 - protein, 7 aa, synthetic construct
  REGION 1..7: note = n-mer motif
LGNGSSL

SEQ ID NO: 4798 - protein, 7 aa, synthetic construct
  REGION 1..7: note = n-mer motif
SGNANIV

SEQ ID NO: 4799 - protein, 7 aa, synthetic construct
  REGION 1..7: note = n-mer motif
GINRTSE

SEQ ID NO: 4800 - protein, 7 aa, synthetic construct
  REGION 1..7: note = n-mer motif
SDNRNTA

SEQ ID NO: 4801 - protein, 7 aa, synthetic construct
  REGION 1..7: note = n-mer motif
RLGTVTN

SEQ ID NO: 4802 - protein, 7 aa, synthetic construct
  REGION 1..7: note = n-mer motif
VEHVAHQ

SEQ ID NO: 4803 - protein, 7 aa, synthetic construct
  REGION 1..7: note = n-mer motif
YTKHPVE

SEQ ID NO: 4804 - protein, 7 aa, synthetic construct
  REGION 1..7: note = n-mer motif
SRITVNA

SEQ ID NO: 4805 - protein, 7 aa, synthetic construct
  REGION 1..7: note = n-mer motif
TVSSYVQ

SEQ ID NO: 4806 - protein, 7 aa, synthetic construct
  REGION 1..7: note = n-mer motif
RAEGSSG

SEQ ID NO: 4807 - protein, 7 aa, synthetic construct
  REGION 1..7: note = n-mer motif
AVGRSDD

SEQ ID NO: 4808 - protein, 7 aa, synthetic construct
  REGION 1..7: note = n-mer motif
RIGVGAP

SEQ ID NO: 4809 - protein, 7 aa, synthetic construct
  REGION 1..7: note = n-mer motif
YSNLVLS

SEQ ID NO: 4810 - protein, 7 aa, synthetic construct
  REGION 1..7: note = n-mer motif
STNSEAV

SEQ ID NO: 4811 - protein, 7 aa, synthetic construct
  REGION 1..7: note = n-mer motif
AMSTHMI

SEQ ID NO: 4812 - protein, 7 aa, synthetic construct
  REGION 1..7: note = n-mer motif
RVDISHF

SEQ ID NO: 4813 - protein, 7 aa, synthetic construct
  REGION 1..7: note = n-mer motif
ILTPLDK

SEQ ID NO: 4814 - protein, 7 aa, synthetic construct
  REGION 1..7: note = n-mer motif
VASTTQT

SEQ ID NO: 4815 - protein, 7 aa, synthetic construct
  REGION 1..7: note = n-mer motif
DRSSATL

SEQ ID NO: 4816 - protein, 7 aa, synthetic construct
  REGION 1..7: note = n-mer motif
DHSEQNS

SEQ ID NO: 4817 - protein, 7 aa, synthetic construct
  REGION 1..7: note = n-mer motif
IRSELEV

SEQ ID NO: 4818 - protein, 7 aa, synthetic construct
  REGION 1..7: note = n-mer motif
ANLGDVE

SEQ ID NO: 4819 - protein, 7 aa, synthetic construct
  REGION 1..7: note = n-mer motif
ELKESQK

SEQ ID NO: 4820 - protein, 7 aa, synthetic construct
  REGION 1..7: note = n-mer motif
SYTAGRP

SEQ ID NO: 4821 - protein, 7 aa, synthetic construct
  REGION 1..7: note = n-mer motif
GPAYNQS

SEQ ID NO: 4822 - protein, 7 aa, synthetic construct
  REGION 1..7: note = n-mer motif
HESHYVS

SEQ ID NO: 4823 - protein, 7 aa, synthetic construct
  REGION 1..7: note = n-mer motif
NGKLGTT

SEQ ID NO: 4824 - protein, 7 aa, synthetic construct
  REGION 1..7: note = n-mer motif
LPPASAG

SEQ ID NO: 4825 - protein, 7 aa, synthetic construct
  REGION 1..7: note = n-mer motif
LSYQTGH

SEQ ID NO: 4826 - protein, 7 aa, synthetic construct
  REGION 1..7: note = n-mer motif
DSQITRL

SEQ ID NO: 4827 - protein, 7 aa, synthetic construct
  REGION 1..7: note = n-mer motif
NVYEGHR

SEQ ID NO: 4828 - protein, 7 aa, synthetic construct
  REGION 1..7: note = n-mer motif
LFTAGST

SEQ ID NO: 4829 - protein, 7 aa, synthetic construct
  REGION 1..7: note = n-mer motif
LVNNDGT

SEQ ID NO: 4830 - protein, 7 aa, synthetic construct
  REGION 1..7: note = n-mer motif
AMNVRSD

SEQ ID NO: 4831 - protein, 7 aa, synthetic construct
  REGION 1..7: note = n-mer motif
ASLDRLP

SEQ ID NO: 4832 - protein, 7 aa, synthetic construct
  REGION 1..7: note = n-mer motif
GSRNGPT

SEQ ID NO: 4833 - protein, 7 aa, synthetic construct
  REGION 1..7: note = n-mer motif
MSDGHSK

SEQ ID NO: 4834 - protein, 7 aa, synthetic construct
  REGION 1..7: note = n-mer motif
SNRTEMP

SEQ ID NO: 4835 - protein, 7 aa, synthetic construct
  REGION 1..7: note = n-mer motif
NVVKNNT

SEQ ID NO: 4836 - protein, 7 aa, synthetic construct
  REGION 1..7: note = n-mer motif
VVDSTYP

SEQ ID NO: 4837 - protein, 7 aa, synthetic construct
  REGION 1..7: note = n-mer motif
VAGGTSE

SEQ ID NO: 4838 - protein, 7 aa, synthetic construct
  REGION 1..7: note = n-mer motif
RADMTPL

SEQ ID NO: 4839 - protein, 7 aa, synthetic construct
  REGION 1..7: note = n-mer motif
GHEQTDA

SEQ ID NO: 4840 - protein, 7 aa, synthetic construct
  REGION 1..7: note = n-mer motif
SALISVV

SEQ ID NO: 4841 - protein, 7 aa, synthetic construct
  REGION 1..7: note = n-mer motif
NSTTAQS

SEQ ID NO: 4842 - protein, 7 aa, synthetic construct
  REGION 1..7: note = n-mer motif
YGDLTTV

SEQ ID NO: 4843 - protein, 7 aa, synthetic construct
  REGION 1..7: note = n-mer motif
ARNDGQG

SEQ ID NO: 4844 - protein, 7 aa, synthetic construct
  REGION 1..7: note = n-mer motif
LNVSSSK

SEQ ID NO: 4845 - protein, 7 aa, synthetic construct
  REGION 1..7: note = n-mer motif
SGVSKER

SEQ ID NO: 4846 - protein, 7 aa, synthetic construct
  REGION 1..7: note = n-mer motif
NMEHTMA

SEQ ID NO: 4847 - protein, 7 aa, synthetic construct
  REGION 1..7: note = n-mer motif
ARPASSD

SEQ ID NO: 4848 - protein, 7 aa, synthetic construct
  REGION 1..7: note = n-mer motif
LREESAR

SEQ ID NO: 4849 - protein, 7 aa, synthetic construct
  REGION 1..7: note = n-mer motif
LANMSAP

SEQ ID NO: 4850 - protein, 7 aa, synthetic construct
  REGION 1..7: note = n-mer motif
NHTVEGR

SEQ ID NO: 4851 - protein, 7 aa, synthetic construct
  REGION 1..7: note = n-mer motif
PQHQHEH

SEQ ID NO: 4852 - protein, 7 aa, synthetic construct
  REGION 1..7: note = n-mer motif
NSSELKT

SEQ ID NO: 4853 - protein, 7 aa, synthetic construct
  REGION 1..7: note = n-mer motif
LVAERLP

SEQ ID NO: 4854 - protein, 7 aa, synthetic construct
  REGION 1..7: note = n-mer motif
NVMHSSS

SEQ ID NO: 4855 - protein, 7 aa, synthetic construct
  REGION 1..7: note = n-mer motif
ASDKGAN

SEQ ID NO: 4856 - protein, 7 aa, synthetic construct
  REGION 1..7: note = n-mer motif
SLDRKPP

SEQ ID NO: 4857 - protein, 7 aa, synthetic construct
  REGION 1..7: note = n-mer motif
TEHEKST

SEQ ID NO: 4858 - protein, 7 aa, synthetic construct
  REGION 1..7: note = n-mer motif
PHNQEMG

SEQ ID NO: 4859 - protein, 7 aa, synthetic construct
  REGION 1..7: note = n-mer motif
ESKTVVI

SEQ ID NO: 4860 - protein, 7 aa, synthetic construct
  REGION 1..7: note = n-mer motif
STGQNLK

SEQ ID NO: 4861 - protein, 7 aa, synthetic construct
  REGION 1..7: note = n-mer motif
VLHVSDV

SEQ ID NO: 4862 - protein, 7 aa, synthetic construct
  REGION 1..7: note = n-mer motif
PDAARSP

SEQ ID NO: 4863 - protein, 7 aa, synthetic construct
  REGION 1..7: note = n-mer motif
APRHAHP

SEQ ID NO: 4864 - protein, 7 aa, synthetic construct
  REGION 1..7: note = n-mer motif
HVNPTPA

SEQ ID NO: 4865 - protein, 7 aa, synthetic construct
  REGION 1..7: note = n-mer motif
LPNERPG

SEQ ID NO: 4866 - protein, 7 aa, synthetic construct
  REGION 1..7: note = n-mer motif
EAKGFGH

SEQ ID NO: 4867 - protein, 7 aa, synthetic construct
  REGION 1..7: note = n-mer motif
SENTSVP

SEQ ID NO: 4868 - protein, 7 aa, synthetic construct
  REGION 1..7: note = n-mer motif
GPGENYR

SEQ ID NO: 4869 - protein, 7 aa, synthetic construct
  REGION 1..7: note = n-mer motif
SHEMNNG

SEQ ID NO: 4870 - protein, 7 aa, synthetic construct
  REGION 1..7: note = n-mer motif
VDTYSGL

SEQ ID NO: 4871 - protein, 7 aa, synthetic construct
  REGION 1..7: note = n-mer motif
GVLGNMV

SEQ ID NO: 4872 - protein, 7 aa, synthetic construct
  REGION 1..7: note = n-mer motif
ALDNSSR

SEQ ID NO: 4873 - protein, 7 aa, synthetic construct
  REGION 1..7: note = n-mer motif
FLGSSNH

SEQ ID NO: 4874 - protein, 7 aa, synthetic construct
  REGION 1..7: note = n-mer motif
PVVHGEP

SEQ ID NO: 4875 - protein, 7 aa, synthetic construct
  REGION 1..7: note = n-mer motif
RREGILM

SEQ ID NO: 4876 - protein, 7 aa, synthetic construct
  REGION 1..7: note = n-mer motif
QQGAPTS

SEQ ID NO: 4877 - protein, 7 aa, synthetic construct
  REGION 1..7: note = n-mer motif
KVSGGET

SEQ ID NO: 4878 - protein, 7 aa, synthetic construct
  REGION 1..7: note = n-mer motif
AKHESSS

SEQ ID NO: 4879 - protein, 7 aa, synthetic construct
  REGION 1..7: note = n-mer motif
ILMGART

SEQ ID NO: 4880 - protein, 7 aa, synthetic construct
  REGION 1..7: note = n-mer motif
TLGSSST

SEQ ID NO: 4881 - protein, 7 aa, synthetic construct
  REGION 1..7: note = n-mer motif
LRSEPTQ

SEQ ID NO: 4882 - protein, 7 aa, synthetic construct
  REGION 1..7: note = n-mer motif
RSEQKTP

SEQ ID NO: 4883 - protein, 7 aa, synthetic construct
  REGION 1..7: note = n-mer motif
HAPSGAI

SEQ ID NO: 4884 - protein, 7 aa, synthetic construct
  REGION 1..7: note = n-mer motif
SSVTSRE

SEQ ID NO: 4885 - protein, 7 aa, synthetic construct
  REGION 1..7: note = n-mer motif
VNPHPAQ

SEQ ID NO: 4886 - protein, 7 aa, synthetic construct
  REGION 1..7: note = n-mer motif
QYSMDTR

SEQ ID NO: 4887 - protein, 7 aa, synthetic construct
  REGION 1..7: note = n-mer motif
TPGVTRT

SEQ ID NO: 4888 - protein, 7 aa, synthetic construct
  REGION 1..7: note = n-mer motif
LYEVGTP

SEQ ID NO: 4889 - protein, 7 aa, synthetic construct
  REGION 1..7: note = n-mer motif
TMTSELS

SEQ ID NO: 4890 - protein, 7 aa, synthetic construct
  REGION 1..7: note = n-mer motif
SGSEYRT

SEQ ID NO: 4891 - protein, 7 aa, synthetic construct
  REGION 1..7: note = n-mer motif
EMQTKNA

SEQ ID NO: 4892 - protein, 7 aa, synthetic construct
  REGION 1..7: note = n-mer motif
GHENMGV

SEQ ID NO: 4893 - protein, 7 aa, synthetic construct
  REGION 1..7: note = n-mer motif
GAHTSAS

SEQ ID NO: 4894 - protein, 7 aa, synthetic construct
  REGION 1..7: note = n-mer motif
ADTLLRR

SEQ ID NO: 4895 - protein, 7 aa, synthetic construct
  REGION 1..7: note = n-mer motif
DNSNNVP

SEQ ID NO: 4896 - protein, 7 aa, synthetic construct
  REGION 1..7: note = n-mer motif
MTANLVE

SEQ ID NO: 4897 - protein, 7 aa, synthetic construct
  REGION 1..7: note = n-mer motif
EAGRTLQ

SEQ ID NO: 4898 - protein, 7 aa, synthetic construct
  REGION 1..7: note = n-mer motif
RHVVPDS

SEQ ID NO: 4899 - protein, 7 aa, synthetic construct
  REGION 1..7: note = n-mer motif
VSSEQYR

SEQ ID NO: 4900 - protein, 7 aa, synthetic construct
  REGION 1..7: note = n-mer motif
GIEASRG

SEQ ID NO: 4901 - protein, 7 aa, synthetic construct
  REGION 1..7: note = n-mer motif
RQGVNGV

SEQ ID NO: 4902 - protein, 7 aa, synthetic construct
  REGION 1..7: note = n-mer motif
TVMMSTR

SEQ ID NO: 4903 - protein, 7 aa, synthetic construct
  REGION 1..7: note = n-mer motif
WQDHNKV

SEQ ID NO: 4904 - protein, 7 aa, synthetic construct
  REGION 1..7: note = n-mer motif
GITGSTG

SEQ ID NO: 4905 - protein, 7 aa, synthetic construct
  REGION 1..7: note = n-mer motif
NYAQRDG

SEQ ID NO: 4906 - protein, 7 aa, synthetic construct
  REGION 1..7: note = n-mer motif
KQEALSS

SEQ ID NO: 4907 - protein, 7 aa, synthetic construct
  REGION 1..7: note = n-mer motif
STLDRSE

SEQ ID NO: 4908 - protein, 7 aa, synthetic construct
  REGION 1..7: note = n-mer motif
AITNTQQ

SEQ ID NO: 4909 - protein, 7 aa, synthetic construct
  REGION 1..7: note = n-mer motif
RLATQSA

SEQ ID NO: 4910 - protein, 7 aa, synthetic construct
  REGION 1..7: note = n-mer motif
WQLTTSH

SEQ ID NO: 4911 - protein, 7 aa, synthetic construct
  REGION 1..7: note = n-mer motif
GGSGSNT

SEQ ID NO: 4912 - protein, 7 aa, synthetic construct
  REGION 1..7: note = n-mer motif
NLVAYTK

SEQ ID NO: 4913 - protein, 7 aa, synthetic construct
  REGION 1..7: note = n-mer motif
KASHDTS

SEQ ID NO: 4914 - protein, 7 aa, synthetic construct
  REGION 1..7: note = n-mer motif
AITIIGT

SEQ ID NO: 4915 - protein, 7 aa, synthetic construct
  REGION 1..7: note = n-mer motif
NASSDRF

SEQ ID NO: 4916 - protein, 7 aa, synthetic construct
  REGION 1..7: note = n-mer motif
ETQRIEL

SEQ ID NO: 4917 - protein, 7 aa, synthetic construct
  REGION 1..7: note = n-mer motif
VIEVNSR

SEQ ID NO: 4918 - protein, 7 aa, synthetic construct
  REGION 1..7: note = n-mer motif
DRDMEGV

SEQ ID NO: 4919 - protein, 7 aa, synthetic construct
  REGION 1..7: note = n-mer motif
ISEMTRY

SEQ ID NO: 4920 - protein, 7 aa, synthetic construct
  REGION 1..7: note = n-mer motif
EHDVSTR

SEQ ID NO: 4921 - protein, 7 aa, synthetic construct
  REGION 1..7: note = n-mer motif
RMEETAY

SEQ ID NO: 4922 - protein, 7 aa, synthetic construct
  REGION 1..7: note = n-mer motif
YSTDLRM

SEQ ID NO: 4923 - protein, 7 aa, synthetic construct
  REGION 1..7: note = n-mer motif
VPEPKKA

SEQ ID NO: 4924 - protein, 7 aa, synthetic construct
  REGION 1..7: note = n-mer motif
TYAPRSP

SEQ ID NO: 4925 - protein, 7 aa, synthetic construct
  REGION 1..7: note = n-mer motif
AAASPLA

SEQ ID NO: 4926 - protein, 7 aa, synthetic construct
  REGION 1..7: note = n-mer motif
SGTYASR

SEQ ID NO: 4927 - protein, 7 aa, synthetic construct
  REGION 1..7: note = n-mer motif
TEASIAA

SEQ ID NO: 4928 - protein, 7 aa, synthetic construct
  REGION 1..7: note = n-mer motif
RIVDTLG

SEQ ID NO: 4929 - protein, 7 aa, synthetic construct
  REGION 1..7: note = n-mer motif
YLQEKFP

SEQ ID NO: 4930 - protein, 7 aa, synthetic construct
  REGION 1..7: note = n-mer motif
VHDQGAG

SEQ ID NO: 4931 - protein, 7 aa, synthetic construct
  REGION 1..7: note = n-mer motif
PQATLNN

SEQ ID NO: 4932 - protein, 7 aa, synthetic construct
  REGION 1..7: note = n-mer motif
CGMSECS

SEQ ID NO: 4933 - protein, 7 aa, synthetic construct
  REGION 1..7: note = n-mer motif
GSHNGPT

SEQ ID NO: 4934 - protein, 7 aa, synthetic construct
  REGION 1..7: note = n-mer motif
FGSGPNL

SEQ ID NO: 4935 - protein, 7 aa, synthetic construct
  REGION 1..7: note = n-mer motif
MDTNTHR

SEQ ID NO: 4936 - protein, 7 aa, synthetic construct
  REGION 1..7: note = n-mer motif
KNNPEDG

SEQ ID NO: 4937 - protein, 7 aa, synthetic construct
  REGION 1..7: note = n-mer motif
LPTATGQ

SEQ ID NO: 4938 - protein, 7 aa, synthetic construct
  REGION 1..7: note = n-mer motif
TAERTEY

SEQ ID NO: 4939 - protein, 7 aa, synthetic construct
  REGION 1..7: note = n-mer motif
NYRDITM

SEQ ID NO: 4940 - protein, 7 aa, synthetic construct
  REGION 1..7: note = n-mer motif
PARSDAL

SEQ ID NO: 4941 - protein, 7 aa, synthetic construct
  REGION 1..7: note = n-mer motif
SVVTLGV

SEQ ID NO: 4942 - protein, 7 aa, synthetic construct
  REGION 1..7: note = n-mer motif
VVKEIKL

SEQ ID NO: 4943 - protein, 7 aa, synthetic construct
  REGION 1..7: note = n-mer motif
DHSKQNS

SEQ ID NO: 4944 - protein, 7 aa, synthetic construct
  REGION 1..7: note = n-mer motif
QSNLVIN

SEQ ID NO: 4945 - protein, 7 aa, synthetic construct
  REGION 1..7: note = n-mer motif
IPVGAMA

SEQ ID NO: 4946 - protein, 7 aa, synthetic construct
  REGION 1..7: note = n-mer motif
TSEMRTA

SEQ ID NO: 4947 - protein, 7 aa, synthetic construct
  REGION 1..7: note = n-mer motif
GSQRAMN

SEQ ID NO: 4948 - protein, 7 aa, synthetic construct
  REGION 1..7: note = n-mer motif
HLSQANH

SEQ ID NO: 4949 - protein, 7 aa, synthetic construct
  REGION 1..7: note = n-mer motif
GGNSHGV

SEQ ID NO: 4950 - protein, 7 aa, synthetic construct
  REGION 1..7: note = n-mer motif
VTRSTKE

SEQ ID NO: 4951 - protein, 7 aa, synthetic construct
  REGION 1..7: note = n-mer motif
MLRASTA

SEQ ID NO: 4952 - protein, 7 aa, synthetic construct
  REGION 1..7: note = n-mer motif
GRQIPEQ

SEQ ID NO: 4953 - protein, 7 aa, synthetic construct
  REGION 1..7: note = n-mer motif
WNQNVSH

SEQ ID NO: 4954 - protein, 7 aa, synthetic construct
  REGION 1..7: note = n-mer motif
QRGELPA

SEQ ID NO: 4955 - protein, 7 aa, synthetic construct
  REGION 1..7: note = n-mer motif
ANDSLRS

SEQ ID NO: 4956 - protein, 7 aa, synthetic construct
  REGION 1..7: note = n-mer motif
NMPPESH

SEQ ID NO: 4957 - protein, 7 aa, synthetic construct
  REGION 1..7: note = n-mer motif
NLSLQSL

SEQ ID NO: 4958 - protein, 7 aa, synthetic construct
  REGION 1..7: note = n-mer motif
TSDGLLS

SEQ ID NO: 4959 - protein, 7 aa, synthetic construct
  REGION 1..7: note = n-mer motif
AGQAYQS

SEQ ID NO: 4960 - protein, 7 aa, synthetic construct
  REGION 1..7: note = n-mer motif
LSVKEEI

SEQ ID NO: 4961 - protein, 7 aa, synthetic construct
  REGION 1..7: note = n-mer motif
DNSPANH

SEQ ID NO: 4962 - protein, 7 aa, synthetic construct
  REGION 1..7: note = n-mer motif
MHNLPSY

SEQ ID NO: 4963 - protein, 7 aa, synthetic construct
  REGION 1..7: note = n-mer motif
YQASNNS

SEQ ID NO: 4964 - protein, 7 aa, synthetic construct
  REGION 1..7: note = n-mer motif
ARAEGVF

SEQ ID NO: 4965 - protein, 7 aa, synthetic construct
  REGION 1..7: note = n-mer motif
GREGNLP

SEQ ID NO: 4966 - protein, 7 aa, synthetic construct
  REGION 1..7: note = n-mer motif
QAAERDR

SEQ ID NO: 4967 - protein, 7 aa, synthetic construct
  REGION 1..7: note = n-mer motif
VENNRMS

SEQ ID NO: 4968 - protein, 7 aa, synthetic construct
  REGION 1..7: note = n-mer motif
NMSHSTL

SEQ ID NO: 4969 - protein, 7 aa, synthetic construct
  REGION 1..7: note = n-mer motif
SSLGLAP

SEQ ID NO: 4970 - protein, 7 aa, synthetic construct
  REGION 1..7: note = n-mer motif
NVAPYSS

SEQ ID NO: 4971 - protein, 7 aa, synthetic construct
  REGION 1..7: note = n-mer motif
RPAQLPE

SEQ ID NO: 4972 - protein, 7 aa, synthetic construct
  REGION 1..7: note = n-mer motif
MSGSGNA

SEQ ID NO: 4973 - protein, 7 aa, synthetic construct
  REGION 1..7: note = n-mer motif
HGGEHRN

SEQ ID NO: 4974 - protein, 7 aa, synthetic construct
  REGION 1..7: note = n-mer motif
ASGARYV

SEQ ID NO: 4975 - protein, 7 aa, synthetic construct
  REGION 1..7: note = n-mer motif
QNHASGE

SEQ ID NO: 4976 - protein, 7 aa, synthetic construct
  REGION 1..7: note = n-mer motif
AHQKDLR

SEQ ID NO: 4977 - protein, 7 aa, synthetic construct
  REGION 1..7: note = n-mer motif
FGKVGTA

SEQ ID NO: 4978 - protein, 7 aa, synthetic construct
  REGION 1..7: note = n-mer motif
LQKSTLA

SEQ ID NO: 4979 - protein, 7 aa, synthetic construct
  REGION 1..7: note = n-mer motif
IHNESYG

SEQ ID NO: 4980 - DNA, 21 bp, synthetic construct
  misc_feature 1..21: note = n-mer motif encoding polynucleotide
  source 1..21: mol_type = other DNA
aggggtgatctttctacgcct

SEQ ID NO: 4981 - DNA, 21 bp, synthetic construct
  misc_feature 1..21: note = n-mer motif encoding polynucleotide
  source 1..21: mol_type = other DNA
agaggcgacttatccacaccc

SEQ ID NO: 4982 - DNA, 21 bp, synthetic construct
  misc_feature 1..21: note = n-mer motif encoding polynucleotide
  source 1..21: mol_type = other DNA
agaggagacttgacaacccca

SEQ ID NO: 4983 - DNA, 21 bp, synthetic construct
  misc_feature 1..21: note = n-mer motif encoding polynucleotide
  source 1..21: mol_type = other DNA
aggggcgacctgaaccaatac

SEQ ID NO: 4984 - DNA, 21 bp, synthetic construct
  misc_feature 1..21: note = n-mer motif encoding polynucleotide
  source 1..21: mol_type = other DNA
cggggtgatcagctttatcat

SEQ ID NO: 4985 - DNA, 21 bp, synthetic construct
  misc_feature 1..21: note = n-mer motif encoding polynucleotide
  source 1..21: mol_type = other DNA
aggggggatgcgacggagctt

SEQ ID NO: 4986 - DNA, 21 bp, synthetic construct
  misc_feature 1..21: note = n-mer motif encoding polynucleotide
  source 1..21: mol_type = other DNA
cgaggagacaccatgagcaaa

SEQ ID NO: 4987 - DNA, 21 bp, synthetic construct
  misc_feature 1..21: note = n-mer motif encoding polynucleotide
  source 1..21: mol_type = other DNA
cggggtgatcttaatcagtat

SEQ ID NO: 4988 - DNA, 21 bp, synthetic construct
  misc_feature 1..21: note = n-mer motif encoding polynucleotide
  source 1..21: mol_type = other DNA
cggggtgatcttactacgcct

SEQ ID NO: 4989 - DNA, 21 bp, synthetic construct
  misc_feature 1..21: note = n-mer motif encoding polynucleotide
  source 1..21: mol_type = other DNA
cgcggcgacatgataaacacc

SEQ ID NO: 4990 - DNA, 21 bp, synthetic construct
  misc_feature 1..21: note = n-mer motif encoding polynucleotide
  source 1..21: mol_type = other DNA
cggggggatactatgtctaag

SEQ ID NO: 4991 - DNA, 21 bp, synthetic construct
  misc_feature 1..21: note = n-mer motif encoding polynucleotide
  source 1..21: mol_type = other DNA
cgaggcgacacaatgaactac

SEQ ID NO: 4992 - DNA, 21 bp, synthetic construct
  misc_feature 1..21: note = n-mer motif encoding polynucleotide
  source 1..21: mol_type = other DNA
cggggtgacgcaacagaattg

SEQ ID NO: 4993 - DNA, 21 bp, synthetic construct
  misc_feature 1..21: note = n-mer motif encoding polynucleotide
  source 1..21: mol_type = other DNA
cgtttggacctgcaagtccac

SEQ ID NO: 4994 - DNA, 21 bp, synthetic construct
  misc_feature 1..21: note = n-mer motif encoding polynucleotide
  source 1..21: mol_type = other DNA
cgtggtgatgtggcggctaag

SEQ ID NO: 4995 - DNA, 21 bp, synthetic construct
  misc_feature 1..21: note = n-mer motif encoding polynucleotide
  source 1..21: mol_type = other DNA
aggggcgacctcaacgacagc

SEQ ID NO: 4996 - DNA, 21 bp, synthetic construct
  misc_feature 1..21: note = n-mer motif encoding polynucleotide
  source 1..21: mol_type = other DNA
cgtggggatttgaatgattct

SEQ ID NO: 4997 - DNA, 21 bp, synthetic construct
  misc_feature 1..21: note = n-mer motif encoding polynucleotide
  source 1..21: mol_type = other DNA
tcttatggtaatactcatgat

SEQ ID NO: 4998 - DNA, 21 bp, synthetic construct
  misc_feature 1..21: note = n-mer motif encoding polynucleotide
  source 1..21: mol_type = other DNA
cgtttggacctgcaagtcaac

SEQ ID NO: 4999 - DNA, 21 bp, synthetic construct
  misc_feature 1..21: note = n-mer motif encoding polynucleotide
  source 1..21: mol_type = other DNA
aaagcgggacaactagtggaa

SEQ ID NO: 5000 - DNA, 21 bp, synthetic construct
  misc_feature 1..21: note = n-mer motif encoding polynucleotide
  source 1..21: mol_type = other DNA
gatcagacggctagtattgtt

SEQ ID NO: 5001 - DNA, 21 bp, synthetic construct
  misc_feature 1..21: note = n-mer motif encoding polynucleotide
  source 1..21: mol_type = other DNA
tatattgctgcgggtgagcag

SEQ ID NO: 5002 - DNA, 21 bp, synthetic construct
  misc_feature 1..21: note = n-mer motif encoding polynucleotide
  source 1..21: mol_type = other DNA
gcggttgttctgaatagtaat

SEQ ID NO: 5003 - DNA, 21 bp, synthetic construct
  misc_feature 1..21: note = n-mer motif encoding polynucleotide
  source 1..21: mol_type = other DNA
tctaaaggaaacgaacaaatg

SEQ ID NO: 5004 - DNA, 21 bp, synthetic construct
  misc_feature 1..21: note = n-mer motif encoding polynucleotide
  source 1..21: mol_type = other DNA
gcaaaccccaacatactagac

SEQ ID NO: 5005 - DNA, 21 bp, synthetic construct
  misc_feature 1..21: note = n-mer motif encoding polynucleotide
  source 1..21: mol_type = other DNA
cacaacaaaccaaacggagac

SEQ ID NO: 5006 - DNA, 21 bp, synthetic construct
  misc_feature 1..21: note = n-mer motif encoding polynucleotide
  source 1..21: mol_type = other DNA
gataagactgagatgctgcag

SEQ ID NO: 5007 - DNA, 21 bp, synthetic construct
  misc_feature 1..21: note = n-mer motif encoding polynucleotide
  source 1..21: mol_type = other DNA
acagaacaatcttactcacga

SEQ ID NO: 5008 - DNA, 21 bp, synthetic construct
  misc_feature 1..21: note = n-mer motif encoding polynucleotide
  source 1..21: mol_type = other DNA
actgtgatgatgagtacgagg

SEQ ID NO: 5009 - DNA, 21 bp, synthetic construct
  misc_feature 1..21: note = n-mer motif encoding polynucleotide
  source 1..21: mol_type = other DNA
gtctctacatacctcctggca

SEQ ID NO: 5010 - DNA, 21 bp, synthetic construct
  misc_feature 1..21: note = n-mer motif encoding polynucleotide
  source 1..21: mol_type = other DNA
cctaatgttacgcagtcttat

SEQ ID NO: 5011 - DNA, 21 bp, synthetic construct
  misc_feature 1..21: note = n-mer motif encoding polynucleotide
  source 1..21: mol_type = other DNA
atgagtaatttggggtatgag

SEQ ID NO: 5012 - DNA, 21 bp, synthetic construct
  misc_feature 1..21: note = n-mer motif encoding polynucleotide
  source 1..21: mol_type = other DNA
acgatgggtgctaatggtact

SEQ ID NO: 5013 - DNA, 21 bp, synthetic construct
  misc_feature 1..21: note = n-mer motif encoding polynucleotide
  source 1..21: mol_type = other DNA
aatgttaatgcgcagagtagg

SEQ ID NO: 5014 - DNA, 21 bp, synthetic construct
  misc_feature 1..21: note = n-mer motif encoding polynucleotide
  source 1..21: mol_type = other DNA
gaccaaaacttcgaacgtaga

SEQ ID NO: 5015 - DNA, 21 bp, synthetic construct
  misc_feature 1..21: note = n-mer motif encoding polynucleotide
  source 1..21: mol_type = other DNA
aacacgtacacaccgggaaaa

SEQ ID NO: 5016 - DNA, 21 bp, synthetic construct
  misc_feature 1..21: note = n-mer motif encoding polynucleotide
  source 1..21: mol_type = other DNA
cgtggggatatgattaatacg

SEQ ID NO: 5017 - DNA, 21 bp, synthetic construct
  misc_feature 1..21: note = n-mer motif encoding polynucleotide
  source 1..21: mol_type = other DNA
gcacaattcgaatcaggccga

SEQ ID NO: 5018 - DNA, 21 bp, synthetic construct
  misc_feature 1..21: note = n-mer motif encoding polynucleotide
  source 1..21: mol_type = other DNA
acggcgtatcaggctggtctg

SEQ ID NO: 5019 - DNA, 21 bp, synthetic construct
  misc_feature 1..21: note = n-mer motif encoding polynucleotide
  source 1..21: mol_type = other DNA
agtgttagttctgtggtgttg

SEQ ID NO: 5020 - DNA, 21 bp, synthetic construct
  misc_feature 1..21: note = n-mer motif encoding polynucleotide
  source 1..21: mol_type = other DNA
gggctttctaaggcgtctgat

SEQ ID NO: 5021 - DNA, 21 bp, synthetic construct
  misc_feature 1..21: note = n-mer motif encoding polynucleotide
  source 1..21: mol_type = other DNA
tggaacggaaacgccacacaa

SEQ ID NO: 5022 - DNA, 21 bp, synthetic construct
  misc_feature 1..21: note = n-mer motif encoding polynucleotide
  source 1..21: mol_type = other DNA
acagccggcggcgaacgcgcc

SEQ ID NO: 5023 - DNA, 21 bp, synthetic construct
  misc_feature 1..21: note = n-mer motif encoding polynucleotide
  source 1..21: mol_type = other DNA
tacacctctcaaaccagcact

SEQ ID NO: 5024 - DNA, 21 bp, synthetic construct
  misc_feature 1..21: note = n-mer motif encoding polynucleotide
  source 1..21: mol_type = other DNA
gcgaacatagaaaacacgtca

SEQ ID NO: 5025 - DNA, 21 bp, synthetic construct
  misc_feature 1..21: note = n-mer motif encoding polynucleotide
  source 1..21: mol_type = other DNA
gaactctccgttccgaaacca

SEQ ID NO: 5026 - DNA, 21 bp, synthetic construct
  misc_feature 1..21: note = n-mer motif encoding polynucleotide
  source 1..21: mol_type = other DNA
gatcctggtcggacgggtacg

SEQ ID NO: 5027 - DNA, 21 bp, synthetic construct
  misc_feature 1..21: note = n-mer motif encoding polynucleotide
  source 1..21: mol_type = other DNA
gatcgtccgaataatatgacg

SEQ ID NO: 5028 - DNA, 21 bp, synthetic construct
  misc_feature 1..21: note = n-mer motif encoding polynucleotide
  source 1..21: mol_type = other DNA
tatagtactgatcttaggatg

SEQ ID NO: 5029 - DNA, 21 bp, synthetic construct
  misc_feature 1..21: note = n-mer motif encoding polynucleotide
  source 1..21: mol_type = other DNA
cagtcggttaatagtacgagt

SEQ ID NO: 5030 - DNA, 21 bp, synthetic construct
  misc_feature 1..21: note = n-mer motif encoding polynucleotide
  source 1..21: mol_type = other DNA
gcggcacaactcgtcagtcca

SEQ ID NO: 5031 - DNA, 21 bp, synthetic construct
  misc_feature 1..21: note = n-mer motif encoding polynucleotide
  source 1..21: mol_type = other DNA
ctcggaggaaacagcaggttc

SEQ ID NO: 5032 - DNA, 21 bp, synthetic construct
  misc_feature 1..21: note = n-mer motif encoding polynucleotide
  source 1..21: mol_type = other DNA
gcgacgctgaataatagttat

SEQ ID NO: 5033 - DNA, 21 bp, synthetic construct
  misc_feature 1..21: note = n-mer motif encoding polynucleotide
  source 1..21: mol_type = other DNA
cgcttggacgttggaagcccg

SEQ ID NO: 5034 - DNA, 21 bp, synthetic construct
  misc_feature 1..21: note = n-mer motif encoding polynucleotide
  source 1..21: mol_type = other DNA
tatcggggtagggaggattgg

SEQ ID NO: 5035 - DNA, 21 bp, synthetic construct
  misc_feature 1..21: note = n-mer motif encoding polynucleotide
  source 1..21: mol_type = other DNA
aggggagatctttctacgcct

SEQ ID NO: 5036 - DNA, 21 bp, synthetic construct
  misc_feature 1..21: note = n-mer motif encoding polynucleotide
  source 1..21: mol_type = other DNA
agtggtctttcgcatggtcag

SEQ ID NO: 5037 - DNA, 21 bp, synthetic construct
  misc_feature 1..21: note = n-mer motif encoding polynucleotide
  source 1..21: mol_type = other DNA
gaacacgctacagcaaaacaa

SEQ ID NO: 5038 - DNA, 21 bp, synthetic construct
  misc_feature 1..21: note = n-mer motif encoding polynucleotide
  source 1..21: mol_type = other DNA
ggggcggaagcgggccgccaa

SEQ ID NO: 5039 - DNA, 21 bp, synthetic construct
  misc_feature 1..21: note = n-mer motif encoding polynucleotide
  source 1..21: mol_type = other DNA
ataagcggttccactacacac

SEQ ID NO: 5040 - DNA, 21 bp, synthetic construct
  misc_feature 1..21: note = n-mer motif encoding polynucleotide
  source 1..21: mol_type = other DNA
ggcaccgtcgttccgggctcc

SEQ ID NO: 5041 - DNA, 21 bp, synthetic construct
  misc_feature 1..21: note = n-mer motif encoding polynucleotide
  source 1..21: mol_type = other DNA
cataataataatatgctgaat

SEQ ID NO: 5042 - DNA, 21 bp, synthetic construct
  misc_feature 1..21: note = n-mer motif encoding polynucleotide
  source 1..21: mol_type = other DNA
cgtctgactgatactatgcat

SEQ ID NO: 5043 - DNA, 21 bp, synthetic construct
  misc_feature 1..21: note = n-mer motif encoding polynucleotide
  source 1..21: mol_type = other DNA
aacacctaccccttcaacgcc

SEQ ID NO: 5044 - DNA, 21 bp, synthetic construct
  misc_feature 1..21: note = n-mer motif encoding polynucleotide
  source 1..21: mol_type = other DNA
tcaaccactactggccacatg

SEQ ID NO: 5045 - DNA, 21 bp, synthetic construct
  misc_feature 1..21: note = n-mer motif encoding polynucleotide
  source 1..21: mol_type = other DNA
gtgcataatcctactactacg

SEQ ID NO: 5046 - DNA, 21 bp, synthetic construct
  misc_feature 1..21: note = n-mer motif encoding polynucleotide
  source 1..21: mol_type = other DNA
aatctgcaggtgaatgcgaat

SEQ ID NO: 5047 - DNA, 21 bp, synthetic construct
  misc_feature 1..21: note = n-mer motif encoding polynucleotide
  source 1..21: mol_type = other DNA
agatacggagaatccatcgaa

SEQ ID NO: 5048 - DNA, 21 bp, synthetic construct
  misc_feature 1..21: note = n-mer motif encoding polynucleotide
  source 1..21: mol_type = other DNA
aatactactccgcctaatcat

SEQ ID NO: 5049 - DNA, 21 bp, synthetic construct
  misc_feature 1..21: note = n-mer motif encoding polynucleotide
  source 1..21: mol_type = other DNA
aatactttgcagaatagtcat

SEQ ID NO: 5050 - DNA, 21 bp, synthetic construct
  misc_feature 1..21: note = n-mer motif encoding polynucleotide
  source 1..21: mol_type = other DNA
agtctgaacaacatgggatcg

SEQ ID NO: 5051 - DNA, 21 bp, synthetic construct
  misc_feature 1..21: note = n-mer motif encoding polynucleotide
  source 1..21: mol_type = other DNA
agaaacgaaaacgtaaacgct

SEQ ID NO: 5052 - DNA, 21 bp, synthetic construct
  misc_feature 1..21: note = n-mer motif encoding polynucleotide
  source 1..21: mol_type = other DNA
gctgtgcatgcgactagtagt

SEQ ID NO: 5053 - DNA, 21 bp, synthetic construct
  misc_feature 1..21: note = n-mer motif encoding polynucleotide
  source 1..21: mol_type = other DNA
acccaacacctaccatccaca

SEQ ID NO: 5054 - DNA, 21 bp, synthetic construct
  misc_feature 1..21: note = n-mer motif encoding polynucleotide
  source 1..21: mol_type = other DNA
agtgtgttgtctcaggctaat

SEQ ID NO: 5055 - DNA, 21 bp, synthetic construct
  misc_feature 1..21: note = n-mer motif encoding polynucleotide
  source 1..21: mol_type = other DNA
agtagctcaactgaagggcaa

SEQ ID NO: 5056 - DNA, 21 bp, synthetic construct
  misc_feature 1..21: note = n-mer motif encoding polynucleotide
  source 1..21: mol_type = other DNA
ggtcggacggatactcctaat

SEQ ID NO: 5057 - DNA, 21 bp, synthetic construct
  misc_feature 1..21: note = n-mer motif encoding polynucleotide
  source 1..21: mol_type = other DNA
gttcaaacccacataggagtc

SEQ ID NO: 5058 - DNA, 21 bp, synthetic construct
  misc_feature 1..21: note = n-mer motif encoding polynucleotide
  source 1..21: mol_type = other DNA
acttctgctagtgagaattgg

SEQ ID NO: 5059 - DNA, 21 bp, synthetic construct
  misc_feature 1..21: note = n-mer motif encoding polynucleotide
  source 1..21: mol_type = other DNA
ggaaaagccaacgacggttct

SEQ ID NO: 5060 - DNA, 21 bp, synthetic construct
  misc_feature 1..21: note = n-mer motif encoding polynucleotide
  source 1..21: mol_type = other DNA
gtggagcggaatactgatatg

SEQ ID NO: 5061 - DNA, 21 bp, synthetic construct
  misc_feature 1..21: note = n-mer motif encoding polynucleotide
  source 1..21: mol_type = other DNA
caaaaccacgcgtctggtgaa

SEQ ID NO: 5062 - DNA, 21 bp, synthetic construct
  misc_feature 1..21: note = n-mer motif encoding polynucleotide
  source 1..21: mol_type = other DNA
tattatgagaagcttagtgcg

SEQ ID NO: 5063 - DNA, 21 bp, synthetic construct
  misc_feature 1..21: note = n-mer motif encoding polynucleotide
  source 1..21: mol_type = other DNA
ttcatcgctaacactaaccca

SEQ ID NO: 5064 - DNA, 21 bp, synthetic construct
  misc_feature 1..21: note = n-mer motif encoding polynucleotide
  source 1..21: mol_type = other DNA
acctccacggcttcaaaacaa

SEQ ID NO: 5065 - DNA, 21 bp, synthetic construct
  misc_feature 1..21: note = n-mer motif encoding polynucleotide
  source 1..21: mol_type = other DNA
aataatgataatggttttgtt

SEQ ID NO: 5066 - DNA, 21 bp, synthetic construct
  misc_feature 1..21: note = n-mer motif encoding polynucleotide
  source 1..21: mol_type = other DNA
gctaattctattgggggtccg

SEQ ID NO: 5067 - DNA, 21 bp, synthetic construct
  misc_feature 1..21: note = n-mer motif encoding polynucleotide
  source 1..21: mol_type = other DNA
actggccaattagtaggaacc

SEQ ID NO: 5068 - DNA, 21 bp, synthetic construct
  misc_feature 1..21: note = n-mer motif encoding polynucleotide
  source 1..21: mol_type = other DNA
tacagtcaatcgctgtctgaa

SEQ ID NO: 5069 - DNA, 21 bp, synthetic construct
  misc_feature 1..21: note = n-mer motif encoding polynucleotide
  source 1..21: mol_type = other DNA
gtctacaacggcaacgtagta

SEQ ID NO: 5070 - DNA, 21 bp, synthetic construct
  misc_feature 1..21: note = n-mer motif encoding polynucleotide
  source 1..21: mol_type = other DNA
aactcggctgaatcctcgaga

SEQ ID NO: 5071 - DNA, 21 bp, synthetic construct
  misc_feature 1..21: note = n-mer motif encoding polynucleotide
  source 1..21: mol_type = other DNA
acgcgtaatttgtctgagagt

SEQ ID NO: 5072 - DNA, 21 bp, synthetic construct
  misc_feature 1..21: note = n-mer motif encoding polynucleotide
  source 1..21: mol_type = other DNA
tctatgtctgatgggcttcgg

SEQ ID NO: 5073 - DNA, 21 bp, synthetic construct
  misc_feature 1..21: note = n-mer motif encoding polynucleotide
  source 1..21: mol_type = other DNA
gtaggcgaccaatcccgcccg

SEQ ID NO: 5074 - DNA, 21 bp, synthetic construct
  misc_feature 1..21: note = n-mer motif encoding polynucleotide
  source 1..21: mol_type = other DNA
tttacggtgaatcaggatctt

SEQ ID NO: 5075 - DNA, 21 bp, synthetic construct
  misc_feature 1..21: note = n-mer motif encoding polynucleotide
  source 1..21: mol_type = other DNA
tatcataagtatagtacggat

SEQ ID NO: 5076 - DNA, 21 bp, synthetic construct
  misc_feature 1..21: note = n-mer motif encoding polynucleotide
  source 1..21: mol_type = other DNA
tatggtgtgcaggcgaatagt

SEQ ID NO: 5077 - DNA, 21 bp, synthetic construct
  misc_feature 1..21: note = n-mer motif encoding polynucleotide
  source 1..21: mol_type = other DNA
ttgcagacgcctgggacgacg

SEQ ID NO: 5078 - DNA, 21 bp, synthetic construct
  misc_feature 1..21: note = n-mer motif encoding polynucleotide
  source 1..21: mol_type = other DNA
tatcagcagacttctagtacg

SEQ ID NO: 5079 - DNA, 21 bp, synthetic construct
  misc_feature 1..21: note = n-mer motif encoding polynucleotide
  source 1..21: mol_type = other DNA
caaacgaacaccaacgacaga

SEQ ID NO: 5080 - DNA, 21 bp, synthetic construct
  misc_feature 1..21: note = n-mer motif encoding polynucleotide
  source 1..21: mol_type = other DNA
atggataagtctaataattct

SEQ ID NO: 5081 - DNA, 21 bp, synthetic construct
  misc_feature 1..21: note = n-mer motif encoding polynucleotide
  source 1..21: mol_type = other DNA
catcttagtcaggctaatcat

SEQ ID NO: 5082 - DNA, 21 bp, synthetic construct
  misc_feature 1..21: note = n-mer motif encoding polynucleotide
  source 1..21: mol_type = other DNA
gttggtgcgagtacggcttcg

SEQ ID NO: 5083 - DNA, 21 bp, synthetic construct
  misc_feature 1..21: note = n-mer motif encoding polynucleotide
  source 1..21: mol_type = other DNA
cacaacaacaacctgcaaaac

SEQ ID NO: 5084 - DNA, 21 bp, synthetic construct
  misc_feature 1..21: note = n-mer motif encoding polynucleotide
  source 1..21: mol_type = other DNA
agtacttatgggaatacttat

SEQ ID NO: 5085 - DNA, 21 bp, synthetic construct
  misc_feature 1..21: note = n-mer motif encoding polynucleotide
  source 1..21: mol_type = other DNA
cgggctgatgtttcttggtct

SEQ ID NO: 5086 - DNA, 21 bp, synthetic construct
  misc_feature 1..21: note = n-mer motif encoding polynucleotide
  source 1..21: mol_type = other DNA
cgaggagacaacagcacaccg

SEQ ID NO: 5087 - DNA, 21 bp, synthetic construct
  misc_feature 1..21: note = n-mer motif encoding polynucleotide
  source 1..21: mol_type = other DNA
ggtcgggattatgctatgagt

SEQ ID NO: 5088 - DNA, 21 bp, synthetic construct
  misc_feature 1..21: note = n-mer motif encoding polynucleotide
  source 1..21: mol_type = other DNA
cctaacaacgaaaaaaacccg

SEQ ID NO: 5089 - DNA, 21 bp, synthetic construct
  misc_feature 1..21: note = n-mer motif encoding polynucleotide
  source 1..21: mol_type = other DNA
gataatgtgaattctcagcct

SEQ ID NO: 5090 - DNA, 21 bp, synthetic construct
  misc_feature 1..21: note = n-mer motif encoding polynucleotide
  source 1..21: mol_type = other DNA
atggggactgagtatcgtatg

SEQ ID NO: 5091 - DNA, 21 bp, synthetic construct
  misc_feature 1..21: note = n-mer motif encoding polynucleotide
  source 1..21: mol_type = other DNA
aatcagagtattaataatatt

SEQ ID NO: 5092 - DNA, 21 bp, synthetic construct
  misc_feature 1..21: note = n-mer motif encoding polynucleotide
  source 1..21: mol_type = other DNA
gccatagactctatcaaacaa

SEQ ID NO: 5093 - DNA, 21 bp, synthetic construct
  misc_feature 1..21: note = n-mer motif encoding polynucleotide
  source 1..21: mol_type = other DNA
gttgagtcttcttattctcgg

SEQ ID NO: 5094 - DNA, 21 bp, synthetic construct
  misc_feature 1..21: note = n-mer motif encoding polynucleotide
  source 1..21: mol_type = other DNA
ggtcagtatagtcagacgctt

SEQ ID NO: 5095 - DNA, 21 bp, synthetic construct
  misc_feature 1..21: note = n-mer motif encoding polynucleotide
  source 1..21: mol_type = other DNA
accatccaagaccacataaaa

SEQ ID NO: 5096 - DNA, 21 bp, synthetic construct
  misc_feature 1..21: note = n-mer motif encoding polynucleotide
  source 1..21: mol_type = other DNA
aacagttcccaatggcccaac

SEQ ID NO: 5097 - DNA, 21 bp, synthetic construct
  misc_feature 1..21: note = n-mer motif encoding polynucleotide
  source 1..21: mol_type = other DNA
acggataatggtcttcttgtg

SEQ ID NO: 5098 - DNA, 21 bp, synthetic construct
  misc_feature 1..21: note = n-mer motif encoding polynucleotide
  source 1..21: mol_type = other DNA
gtaagagaaaccacacacctc

SEQ ID NO: 5099 - DNA, 21 bp, synthetic construct
  misc_feature 1..21: note = n-mer motif encoding polynucleotide
  source 1..21: mol_type = other DNA
cgtggtgatatgactcgtgcg

SEQ ID NO: 5100 - DNA, 21 bp, synthetic construct
  misc_feature 1..21: note = n-mer motif encoding polynucleotide
  source 1..21: mol_type = other DNA
acttatggtattactcatgat

SEQ ID NO: 5101 - DNA, 21 bp, synthetic construct
  misc_feature 1..21: note = n-mer motif encoding polynucleotide
  source 1..21: mol_type = other DNA
acggcgctgaatacgtatcct

SEQ ID NO: 5102 - DNA, 21 bp, synthetic construct
  misc_feature 1..21: note = n-mer motif encoding polynucleotide
  source 1..21: mol_type = other DNA
ggtggcgaaaacagaacccca

SEQ ID NO: 5103 - DNA, 21 bp, synthetic construct
  misc_feature 1..21: note = n-mer motif encoding polynucleotide
  source 1..21: mol_type = other DNA
tatctgcaggagaagtttcct

SEQ ID NO: 5104 - DNA, 21 bp, synthetic construct
  misc_feature 1..21: note = n-mer motif encoding polynucleotide
  source 1..21: mol_type = other DNA
cttaatcttactaatcataat

SEQ ID NO: 5105 - DNA, 21 bp, synthetic construct
  misc_feature 1..21: note = n-mer motif encoding polynucleotide
  source 1..21: mol_type = other DNA
ggattagctagtctacacctg

SEQ ID NO: 5106 - DNA, 21 bp, synthetic construct
  misc_feature 1..21: note = n-mer motif encoding polynucleotide
  source 1..21: mol_type = other DNA
gtagaacacgtagcccaccaa

SEQ ID NO: 5107 - DNA, 21 bp, synthetic construct
  misc_feature 1..21: note = n-mer motif encoding polynucleotide
  source 1..21: mol_type = other DNA
agcgaacaccacgccggaata

SEQ ID NO: 5108 - DNA, 21 bp, synthetic construct
  misc_feature 1..21: note = n-mer motif encoding polynucleotide
  source 1..21: mol_type = other DNA
gaagcgtccaactacgaacga

SEQ ID NO: 5109 - DNA, 21 bp, synthetic construct
  misc_feature 1..21: note = n-mer motif encoding polynucleotide
  source 1..21: mol_type = other DNA
ccctccaacagtgaaagattc

SEQ ID NO: 5110 - DNA, 21 bp, synthetic construct
  misc_feature 1..21: note = n-mer motif encoding polynucleotide
  source 1..21: mol_type = other DNA
tcccccggcaacgggttgcta

SEQ ID NO: 5111 - DNA, 21 bp, synthetic construct
  misc_feature 1..21: note = n-mer motif encoding polynucleotide
  source 1..21: mol_type = other DNA
atactgaaatccgacgcacca

SEQ ID NO: 5112 - DNA, 21 bp, synthetic construct
  misc_feature 1..21: note = n-mer motif encoding polynucleotide
  source 1..21: mol_type = other DNA
tttgatagtgcgaatggtcgg

SEQ ID NO: 5113 - DNA, 21 bp, synthetic construct
  misc_feature 1..21: note = n-mer motif encoding polynucleotide
  source 1..21: mol_type = other DNA
gatggtaagactacgtctaat

SEQ ID NO: 5114 - DNA, 21 bp, synthetic construct
  misc_feature 1..21: note = n-mer motif encoding polynucleotide
  source 1..21: mol_type = other DNA
actaattatcctgaggcgaat

SEQ ID NO: 5115 - DNA, 21 bp, synthetic construct
  misc_feature 1..21: note = n-mer motif encoding polynucleotide
  source 1..21: mol_type = other DNA
cgaggagaccacagcacaccg

SEQ ID NO: 5116 - DNA, 21 bp, synthetic construct
  misc_feature 1..21: note = n-mer motif encoding polynucleotide
  source 1..21: mol_type = other DNA
cagacgactattctggctgct

SEQ ID NO: 5117 - DNA, 21 bp, synthetic construct
  misc_feature 1..21: note = n-mer motif encoding polynucleotide
  source 1..21: mol_type = other DNA
gctactgcgcatcaggatggt

SEQ ID NO: 5118 - DNA, 21 bp, synthetic construct
  misc_feature 1..21: note = n-mer motif encoding polynucleotide
  source 1..21: mol_type = other DNA
caagccctggccaccacaaac

SEQ ID NO: 5119 - DNA, 21 bp, synthetic construct
  misc_feature 1..21: note = n-mer motif encoding polynucleotide
  source 1..21: mol_type = other DNA
tataatgctactccttcgcag

SEQ ID NO: 5120 - DNA, 21 bp, synthetic construct
  misc_feature 1..21: note = n-mer motif encoding polynucleotide
  source 1..21: mol_type = other DNA
gagctgtctactcctatggtt

SEQ ID NO: 5121 - DNA, 21 bp, synthetic construct
  misc_feature 1..21: note = n-mer motif encoding polynucleotide
  source 1..21: mol_type = other DNA
attaatattagtagtgatttt

SEQ ID NO: 5122 - DNA, 21 bp, synthetic construct
  misc_feature 1..21: note = n-mer motif encoding polynucleotide
  source 1..21: mol_type = other DNA
gtaacggcacaccaattatcc

SEQ ID NO: 5123 - DNA, 21 bp, synthetic construct
  misc_feature 1..21: note = n-mer motif encoding polynucleotide
  source 1..21: mol_type = other DNA
ggagaaagctcctcaataagc

SEQ ID NO: 5124 - DNA, 21 bp, synthetic construct
  misc_feature 1..21: note = n-mer motif encoding polynucleotide
  source 1..21: mol_type = other DNA
gaatccctcccaatctctaaa

SEQ ID NO: 5125 - DNA, 21 bp, synthetic construct
  misc_feature 1..21: note = n-mer motif encoding polynucleotide
  source 1..21: mol_type = other DNA
acgaatgttagtacgcttttg

SEQ ID NO: 5126 - DNA, 21 bp, synthetic construct
  misc_feature 1..21: note = n-mer motif encoding polynucleotide
  source 1..21: mol_type = other DNA
tggcagacgaatggtatgcag

SEQ ID NO: 5127 - DNA, 21 bp, synthetic construct
  misc_feature 1..21: note = n-mer motif encoding polynucleotide
  source 1..21: mol_type = other DNA
tacaggatggaaacgaaccca

SEQ ID NO: 5128 - DNA, 21 bp, synthetic construct
  misc_feature 1..21: note = n-mer motif encoding polynucleotide
  source 1..21: mol_type = other DNA
ataaccggcaacaccgtcgga

SEQ ID NO: 5129 - DNA, 21 bp, synthetic construct
  misc_feature 1..21: note = n-mer motif encoding polynucleotide
  source 1..21: mol_type = other DNA
ctgaacactctaatccacaaa

SEQ ID NO: 5130 - DNA, 21 bp, synthetic construct
  misc_feature 1..21: note = n-mer motif encoding polynucleotide
  source 1..21: mol_type = other DNA
gggacttccttggaaaaccga

SEQ ID NO: 5131 - DNA, 21 bp, synthetic construct
  misc_feature 1..21: note = n-mer motif encoding polynucleotide
  source 1..21: mol_type = other DNA
taccaacacaaccaagcccac

SEQ ID NO: 5132 - DNA, 21 bp, synthetic construct
  misc_feature 1..21: note = n-mer motif encoding polynucleotide
  source 1..21: mol_type = other DNA
attgagagtaagactgtgcag

SEQ ID NO: 5133 - DNA, 21 bp, synthetic construct
  misc_feature 1..21: note = n-mer motif encoding polynucleotide
  source 1..21: mol_type = other DNA
tatacgcagggtattatgaat

SEQ ID NO: 5134 - DNA, 21 bp, synthetic construct
  misc_feature 1..21: note = n-mer motif encoding polynucleotide
  source 1..21: mol_type = other DNA
agtacgaatgaggctcctaag

SEQ ID NO: 5135 - DNA, 21 bp, synthetic construct
  misc_feature 1..21: note = n-mer motif encoding polynucleotide
  source 1..21: mol_type = other DNA
ttgtctcagaattttaatcct

SEQ ID NO: 5136 - DNA, 21 bp, synthetic construct
  misc_feature 1..21: note = n-mer motif encoding polynucleotide
  source 1..21: mol_type = other DNA
tactcttctgaaatgagcgaa

SEQ ID NO: 5137 - DNA, 21 bp, synthetic construct
  misc_feature 1..21: note = n-mer motif encoding polynucleotide
  source 1..21: mol_type = other DNA
tcatacggaggatctggcccc

SEQ ID NO: 5138 - DNA, 21 bp, synthetic construct
  misc_feature 1..21: note = n-mer motif encoding polynucleotide
  source 1..21: mol_type = other DNA
atggacgctgcgtacggtagt

SEQ ID NO: 5139 - DNA, 21 bp, synthetic construct
  misc_feature 1..21: note = n-mer motif encoding polynucleotide
  source 1..21: mol_type = other DNA
ccttttaatcctgggaatgtg

SEQ ID NO: 5140 - DNA, 21 bp, synthetic construct
  misc_feature 1..21: note = n-mer motif encoding polynucleotide
  source 1..21: mol_type = other DNA
caaaaatcggaaacctacact

SEQ ID NO: 5141 - DNA, 21 bp, synthetic construct
  misc_feature 1..21: note = n-mer motif encoding polynucleotide
  source 1..21: mol_type = other DNA
aacaaagaccacaaccacctg

SEQ ID NO: 5142 - DNA, 21 bp, synthetic construct
  misc_feature 1..21: note = n-mer motif encoding polynucleotide
  source 1..21: mol_type = other DNA
ctaaccggctctgacatgaaa

SEQ ID NO: 5143 - DNA, 21 bp, synthetic construct
  misc_feature 1..21: note = n-mer motif encoding polynucleotide
  source 1..21: mol_type = other DNA
tctaaggatagtactatgtat

SEQ ID NO: 5144 - DNA, 21 bp, synthetic construct
  misc_feature 1..21: note = n-mer motif encoding polynucleotide
  source 1..21: mol_type = other DNA
gaagcattcccgcgagcgggc

SEQ ID NO: 5145 - DNA, 21 bp, synthetic construct
  misc_feature 1..21: note = n-mer motif encoding polynucleotide
  source 1..21: mol_type = other DNA
gaacacactcacttaaacccg

SEQ ID NO: 5146 - DNA, 21 bp, synthetic construct
  misc_feature 1..21: note = n-mer motif encoding polynucleotide
  source 1..21: mol_type = other DNA
agttcggacccaaaaggtcaa

SEQ ID NO: 5147 - DNA, 21 bp, synthetic construct
  misc_feature 1..21: note = n-mer motif encoding polynucleotide
  source 1..21: mol_type = other DNA
aaaaccatcgacatagcacaa

SEQ ID NO: 5148 - DNA, 21 bp, synthetic construct
  misc_feature 1..21: note = n-mer motif encoding polynucleotide
  source 1..21: mol_type = other DNA
accggtagcttgaactctatg

SEQ ID NO: 5149 - DNA, 21 bp, synthetic construct
  misc_feature 1..21: note = n-mer motif encoding polynucleotide
  source 1..21: mol_type = other DNA
atgcaacgcgaagacgcgaac

SEQ ID NO: 5150 - DNA, 21 bp, synthetic construct
  misc_feature 1..21: note = n-mer motif encoding polynucleotide
  source 1..21: mol_type = other DNA
gcctctacagtctcactctac

SEQ ID NO: 5151 - DNA, 21 bp, synthetic construct
  misc_feature 1..21: note = n-mer motif encoding polynucleotide
  source 1..21: mol_type = other DNA
ggccgtgacgacctcacaaac

SEQ ID NO: 5152 - DNA, 21 bp, synthetic construct
  misc_feature 1..21: note = n-mer motif encoding polynucleotide
  source 1..21: mol_type = other DNA
tctaatccgggtaatcataat

SEQ ID NO: 5153 - DNA, 21 bp, synthetic construct
  misc_feature 1..21: note = n-mer motif encoding polynucleotide
  source 1..21: mol_type = other DNA
gatacttataagggtaagtgg

SEQ ID NO: 5154 - DNA, 21 bp, synthetic construct
  misc_feature 1..21: note = n-mer motif encoding polynucleotide
  source 1..21: mol_type = other DNA
ccacccaacggcagcagtaga

SEQ ID NO: 5155 - DNA, 21 bp, synthetic construct
  misc_feature 1..21: note = n-mer motif encoding polynucleotide
  source 1..21: mol_type = other DNA
gcttcttatagtatttctgat

SEQ ID NO: 5156 - DNA, 21 bp, synthetic construct
  misc_feature 1..21: note = n-mer motif encoding polynucleotide
  source 1..21: mol_type = other DNA
gtgactgttagtctggatggg

SEQ ID NO: 5157 - DNA, 21 bp, synthetic construct
  misc_feature 1..21: note = n-mer motif encoding polynucleotide
  source 1..21: mol_type = other DNA
atggccataggccactcccca

SEQ ID NO: 5158 - DNA, 21 bp, synthetic construct
  misc_feature 1..21: note = n-mer motif encoding polynucleotide
  source 1..21: mol_type = other DNA
tttcggacggtgtatactggt

SEQ ID NO: 5159 - DNA, 21 bp, synthetic construct
  misc_feature 1..21: note = n-mer motif encoding polynucleotide
  source 1..21: mol_type = other DNA
aaaaaacggcagcccatcgcc

SEQ ID NO: 5160 - DNA, 21 bp, synthetic construct
  misc_feature 1..21: note = n-mer motif encoding polynucleotide
  source 1..21: mol_type = other DNA
aaaaataagctctactatggc

SEQ ID NO: 5161 - DNA, 21 bp, synthetic construct
  misc_feature 1..21: note = n-mer motif encoding polynucleotide
  source 1..21: mol_type = other DNA
tctacatctccggttaacagc

SEQ ID NO: 5162 - DNA, 21 bp, synthetic construct
  misc_feature 1..21: note = n-mer motif encoding polynucleotide
  source 1..21: mol_type = other DNA
gggtctgggattgcggggact

SEQ ID NO: 5163 - DNA, 21 bp, synthetic construct
  misc_feature 1..21: note = n-mer motif encoding polynucleotide
  source 1..21: mol_type = other DNA
atcgacgtactgaacggaagt

SEQ ID NO: 5164 - DNA, 21 bp, synthetic construct
  misc_feature 1..21: note = n-mer motif encoding polynucleotide
  source 1..21: mol_type = other DNA
ggtcataatatggcacaggcg

SEQ ID NO: 5165 - DNA, 21 bp, synthetic construct
  misc_feature 1..21: note = n-mer motif encoding polynucleotide
  source 1..21: mol_type = other DNA
acgaggagcaactccgacgaa

SEQ ID NO: 5166 - DNA, 21 bp, synthetic construct
  misc_feature 1..21: note = n-mer motif encoding polynucleotide
  source 1..21: mol_type = other DNA
ggagcaaaaggaaccatgggc

SEQ ID NO: 5167 - DNA, 21 bp, synthetic construct
  misc_feature 1..21: note = n-mer motif encoding polynucleotide
  source 1..21: mol_type = other DNA
gctactactcttactggtgat

SEQ ID NO: 5168 - DNA, 21 bp, synthetic construct
  misc_feature 1..21: note = n-mer motif encoding polynucleotide
  source 1..21: mol_type = other DNA
ttcaacacatcgtcggaattc

SEQ ID NO: 5169 - DNA, 21 bp, synthetic construct
  misc_feature 1..21: note = n-mer motif encoding polynucleotide
  source 1..21: mol_type = other DNA
tatacggcgcagaccggctgg

SEQ ID NO: 5170 - DNA, 21 bp, synthetic construct
  misc_feature 1..21: note = n-mer motif encoding polynucleotide
  source 1..21: mol_type = other DNA
cgagtaaacaacgacgcaata

SEQ ID NO: 5171 - DNA, 21 bp, synthetic construct
  misc_feature 1..21: note = n-mer motif encoding polynucleotide
  source 1..21: mol_type = other DNA
actattcagcttactgatact

SEQ ID NO: 5172 - DNA, 21 bp, synthetic construct
  misc_feature 1..21: note = n-mer motif encoding polynucleotide
  source 1..21: mol_type = other DNA
gccagcatgccctctgtagac

SEQ ID NO: 5173 - DNA, 21 bp, synthetic construct
  misc_feature 1..21: note = n-mer motif encoding polynucleotide
  source 1..21: mol_type = other DNA
aatcaggtgggtgcgtctgcg

SEQ ID NO: 5174 - DNA, 21 bp, synthetic construct
  misc_feature 1..21: note = n-mer motif encoding polynucleotide
  source 1..21: mol_type = other DNA
ggaaacatggtgactccaaac

SEQ ID NO: 5175 - DNA, 21 bp, synthetic construct
  misc_feature 1..21: note = n-mer motif encoding polynucleotide
  source 1..21: mol_type = other DNA
cgtggtgaccaaggcacacac

SEQ ID NO: 5176 - DNA, 21 bp, synthetic construct
  misc_feature 1..21: note = n-mer motif encoding polynucleotide
  source 1..21: mol_type = other DNA
tcgagtgattctcgtattccg

SEQ ID NO: 5177 - DNA, 21 bp, synthetic construct
  misc_feature 1..21: note = n-mer motif encoding polynucleotide
  source 1..21: mol_type = other DNA
ggactgcacggcaccaacgca

SEQ ID NO: 5178 - DNA, 21 bp, synthetic construct
  misc_feature 1..21: note = n-mer motif encoding polynucleotide
  source 1..21: mol_type = other DNA
tctagttatcagtctgggctg

SEQ ID NO: 5179 - DNA, 21 bp, synthetic construct
  misc_feature 1..21: note = n-mer motif encoding polynucleotide
  source 1..21: mol_type = other DNA
acagcctactcgcccacagtc

SEQ ID NO: 5180 - DNA, 21 bp, synthetic construct
  misc_feature 1..21: note = n-mer motif encoding polynucleotide
  source 1..21: mol_type = other DNA
cgcagtgacaccactaacgcc

SEQ ID NO: 5181 - DNA, 21 bp, synthetic construct
  misc_feature 1..21: note = n-mer motif encoding polynucleotide
  source 1..21: mol_type = other DNA
cgtattgtggctaatgagcag

SEQ ID NO: 5182 - DNA, 21 bp, synthetic construct
  misc_feature 1..21: note = n-mer motif encoding polynucleotide
  source 1..21: mol_type = other DNA
atccacaacgaatcatacgtc

SEQ ID NO: 5183 - DNA, 21 bp, synthetic construct
  misc_feature 1..21: note = n-mer motif encoding polynucleotide
  source 1..21: mol_type = other DNA
cagcagaatacgcgtttgccg

SEQ ID NO: 5184 - DNA, 21 bp, synthetic construct
  misc_feature 1..21: note = n-mer motif encoding polynucleotide
  source 1..21: mol_type = other DNA
ggtatcaactcctcacacttc

SEQ ID NO: 5185 - DNA, 21 bp, synthetic construct
  misc_feature 1..21: note = n-mer motif encoding polynucleotide
  source 1..21: mol_type = other DNA
ggtatgacttctaatcaggtt

SEQ ID NO: 5186 - DNA, 21 bp, synthetic construct
  misc_feature 1..21: note = n-mer motif encoding polynucleotide
  source 1..21: mol_type = other DNA
agggagattgttcatagtaat

SEQ ID NO: 5187 - DNA, 21 bp, synthetic construct
  misc_feature 1..21: note = n-mer motif encoding polynucleotide
  source 1..21: mol_type = other DNA
gcagaacacacgtacacggtc

SEQ ID NO: 5188 - DNA, 21 bp, synthetic construct
  misc_feature 1..21: note = n-mer motif encoding polynucleotide
  source 1..21: mol_type = other DNA
cctgctacgctacacctgaca

SEQ ID NO: 5189 - DNA, 21 bp, synthetic construct
  misc_feature 1..21: note = n-mer motif encoding polynucleotide
  source 1..21: mol_type = other DNA
aagcagactgatagtaggggt

SEQ ID NO: 5190 - DNA, 21 bp, synthetic construct
  misc_feature 1..21: note = n-mer motif encoding polynucleotide
  source 1..21: mol_type = other DNA
actatggtagaagtactgcca

SEQ ID NO: 5191 - DNA, 21 bp, synthetic construct
  misc_feature 1..21: note = n-mer motif encoding polynucleotide
  source 1..21: mol_type = other DNA
atcccaaccggccaaactagc

SEQ ID NO: 5192 - DNA, 21 bp, synthetic construct
  misc_feature 1..21: note = n-mer motif encoding polynucleotide
  source 1..21: mol_type = other DNA
atgataaaaaccaacatgttg

SEQ ID NO: 5193 - DNA, 21 bp, synthetic construct
  misc_feature 1..21: note = n-mer motif encoding polynucleotide
  source 1..21: mol_type = other DNA
gcggaacgacccactagagac

SEQ ID NO: 5194 - DNA, 21 bp, synthetic construct
  misc_feature 1..21: note = n-mer motif encoding polynucleotide
  source 1..21: mol_type = other DNA
cgggatctggggcagaccggc

SEQ ID NO: 5195 - DNA, 21 bp, synthetic construct
  misc_feature 1..21: note = n-mer motif encoding polynucleotide
  source 1..21: mol_type = other DNA
aatgaggggcgtgtgcagact

SEQ ID NO: 5196 - DNA, 21 bp, synthetic construct
  misc_feature 1..21: note = n-mer motif encoding polynucleotide
  source 1..21: mol_type = other DNA
actgcggctagtactgcgagg

SEQ ID NO: 5197 - DNA, 21 bp, synthetic construct
  misc_feature 1..21: note = n-mer motif encoding polynucleotide
  source 1..21: mol_type = other DNA
acccaagggaacaacatggta

SEQ ID NO: 5198 - DNA, 21 bp, synthetic construct
  misc_feature 1..21: note = n-mer motif encoding polynucleotide
  source 1..21: mol_type = other DNA
catagtacttttcctacgact

SEQ ID NO: 5199 - DNA, 21 bp, synthetic construct
  misc_feature 1..21: note = n-mer motif encoding polynucleotide
  source 1..21: mol_type = other DNA
caatctatcggccaccccgtt

SEQ ID NO: 5200 - DNA, 21 bp, synthetic construct
  misc_feature 1..21: note = n-mer motif encoding polynucleotide
  source 1..21: mol_type = other DNA
tcgggtgttaatagtgagcgt

SEQ ID NO: 5201 - DNA, 21 bp, synthetic construct
  misc_feature 1..21: note = n-mer motif encoding polynucleotide
  source 1..21: mol_type = other DNA
cctcacgccaacggagtgaca

SEQ ID NO: 5202 - DNA, 21 bp, synthetic construct
  misc_feature 1..21: note = n-mer motif encoding polynucleotide
  source 1..21: mol_type = other DNA
gaccaccaacaagccctagct

SEQ ID NO: 5203 - DNA, 21 bp, synthetic construct
  misc_feature 1..21: note = n-mer motif encoding polynucleotide
  source 1..21: mol_type = other DNA
agtcagcagggttttactctg

SEQ ID NO: 5204 - DNA, 21 bp, synthetic construct
  misc_feature 1..21: note = n-mer motif encoding polynucleotide
  source 1..21: mol_type = other DNA
acaaacgctgctctagtacca

SEQ ID NO: 5205 - DNA, 21 bp, synthetic construct
  misc_feature 1..21: note = n-mer motif encoding polynucleotide
  source 1..21: mol_type = other DNA
ggtgttagtagtaattctgcg

SEQ ID NO: 5206 - DNA, 21 bp, synthetic construct
  misc_feature 1..21: note = n-mer motif encoding polynucleotide
  source 1..21: mol_type = other DNA
catgatacggttggggagagg

SEQ ID NO: 5207 - DNA, 21 bp, synthetic construct
  misc_feature 1..21: note = n-mer motif encoding polynucleotide
  source 1..21: mol_type = other DNA
gcgttaaacgcccaagggatc

SEQ ID NO: 5208 - DNA, 21 bp, synthetic construct
  misc_feature 1..21: note = n-mer motif encoding polynucleotide
  source 1..21: mol_type = other DNA
catgatagtatgtgttgtgcg

SEQ ID NO: 5209 - DNA, 21 bp, synthetic construct
  misc_feature 1..21: note = n-mer motif encoding polynucleotide
  source 1..21: mol_type = other DNA
tacatcgcggcaggggaacaa

SEQ ID NO: 5210 - DNA, 21 bp, synthetic construct
  misc_feature 1..21: note = n-mer motif encoding polynucleotide
  source 1..21: mol_type = other DNA
gagaatgctcgtgagggtgtg

SEQ ID NO: 5211 - DNA, 21 bp, synthetic construct
  misc_feature 1..21: note = n-mer motif encoding polynucleotide
  source 1..21: mol_type = other DNA
gctacggtttataatgagttg

SEQ ID NO: 5212 - DNA, 21 bp, synthetic construct
  misc_feature 1..21: note = n-mer motif encoding polynucleotide
  source 1..21: mol_type = other DNA
gacactaacggaataaaatca

SEQ ID NO: 5213 - DNA, 21 bp, synthetic construct
  misc_feature 1..21: note = n-mer motif encoding polynucleotide
  source 1..21: mol_type = other DNA
aagccgactgcgaatgattgg

SEQ ID NO: 5214 - DNA, 21 bp, synthetic construct
  misc_feature 1..21: note = n-mer motif encoding polynucleotide
  source 1..21: mol_type = other DNA
tatgagagtactcatgttaat

SEQ ID NO: 5215 - DNA, 21 bp, synthetic construct
  misc_feature 1..21: note = n-mer motif encoding polynucleotide
  source 1..21: mol_type = other DNA
tacaccaacgggggccaccta

SEQ ID NO: 5216 - DNA, 21 bp, synthetic construct
  misc_feature 1..21: note = n-mer motif encoding polynucleotide
  source 1..21: mol_type = other DNA
gtagacaaatctagcccagtg

SEQ ID NO: 5217 - DNA, 21 bp, synthetic construct
  misc_feature 1..21: note = n-mer motif encoding polynucleotide
  source 1..21: mol_type = other DNA
ccaatccaaaacgaatcgtcc

SEQ ID NO: 5218 - DNA, 21 bp, synthetic construct
  misc_feature 1..21: note = n-mer motif encoding polynucleotide
  source 1..21: mol_type = other DNA
atacacaaatctagcgtcgaa

SEQ ID NO: 5219 - DNA, 21 bp, synthetic construct
  misc_feature 1..21: note = n-mer motif encoding polynucleotide
  source 1..21: mol_type = other DNA
catgatattagtctggatcgt

SEQ ID NO: 5220 - DNA, 21 bp, synthetic construct
  misc_feature 1..21: note = n-mer motif encoding polynucleotide
  source 1..21: mol_type = other DNA
tggtgaggggctgagtttgcc

SEQ ID NO: 5221 - DNA, 21 bp, synthetic construct
  misc_feature 1..21: note = n-mer motif encoding polynucleotide
  source 1..21: mol_type = other DNA
tactctcaatccataaaaaac

SEQ ID NO: 5222 - DNA, 21 bp, synthetic construct
  misc_feature 1..21: note = n-mer motif encoding polynucleotide
  source 1..21: mol_type = other DNA
gcccaagacaacaaccacgac

SEQ ID NO: 5223 - DNA, 21 bp, synthetic construct
  misc_feature 1..21: note = n-mer motif encoding polynucleotide
  source 1..21: mol_type = other DNA
gggcagaaggagactactgcg

SEQ ID NO: 5224 - DNA, 21 bp, synthetic construct
  misc_feature 1..21: note = n-mer motif encoding polynucleotide
  source 1..21: mol_type = other DNA
aaaagcgaagtacccgcccga

SEQ ID NO: 5225 - DNA, 21 bp, synthetic construct
  misc_feature 1..21: note = n-mer motif encoding polynucleotide
  source 1..21: mol_type = other DNA
gaacttaacaccgcacacgca

SEQ ID NO: 5226 - DNA, 21 bp, synthetic construct
  misc_feature 1..21: note = n-mer motif encoding polynucleotide
  source 1..21: mol_type = other DNA
agcacaaacgcgggacaaagg

SEQ ID NO: 5227 - DNA, 21 bp, synthetic construct
  misc_feature 1..21: note = n-mer motif encoding polynucleotide
  source 1..21: mol_type = other DNA
aaggcggtttcggagattatt

SEQ ID NO: 5228 - DNA, 21 bp, synthetic construct
  misc_feature 1..21: note = n-mer motif encoding polynucleotide
  source 1..21: mol_type = other DNA
accttcacggtcgacggtaga

SEQ ID NO: 5229 - DNA, 21 bp, synthetic construct
  misc_feature 1..21: note = n-mer motif encoding polynucleotide
  source 1..21: mol_type = other DNA
agtacgagtggttataatact

SEQ ID NO: 5230 - DNA, 21 bp, synthetic construct
  misc_feature 1..21: note = n-mer motif encoding polynucleotide
  source 1..21: mol_type = other DNA
aatcatagtctgtcggagcat

SEQ ID NO: 5231 - DNA, 21 bp, synthetic construct
  misc_feature 1..21: note = n-mer motif encoding polynucleotide
  source 1..21: mol_type = other DNA
tctatgcaggatccttctttg

SEQ ID NO: 5232 - DNA, 21 bp, synthetic construct
  misc_feature 1..21: note = n-mer motif encoding polynucleotide
  source 1..21: mol_type = other DNA
gaacaacaaaaaacagacaac

SEQ ID NO: 5233 - DNA, 21 bp, synthetic construct
  misc_feature 1..21: note = n-mer motif encoding polynucleotide
  source 1..21: mol_type = other DNA
gctgttgtgaatgagaatatg

SEQ ID NO: 5234 - DNA, 21 bp, synthetic construct
  misc_feature 1..21: note = n-mer motif encoding polynucleotide
  source 1..21: mol_type = other DNA
ggtcccggagaaaactaccga

SEQ ID NO: 5235 - DNA, 21 bp, synthetic construct
  misc_feature 1..21: note = n-mer motif encoding polynucleotide
  source 1..21: mol_type = other DNA
tacaacgcaggcggagaacaa

SEQ ID NO: 5236 - DNA, 21 bp, synthetic construct
  misc_feature 1..21: note = n-mer motif encoding polynucleotide
  source 1..21: mol_type = other DNA
gtcctctcctccaacctgtac

SEQ ID NO: 5237 - DNA, 21 bp, synthetic construct
  misc_feature 1..21: note = n-mer motif encoding polynucleotide
  source 1..21: mol_type = other DNA
ggtctttatcagaatcctacg

SEQ ID NO: 5238 - DNA, 21 bp, synthetic construct
  misc_feature 1..21: note = n-mer motif encoding polynucleotide
  source 1..21: mol_type = other DNA
agttcggggagtttgattact

SEQ ID NO: 5239 - DNA, 21 bp, synthetic construct
  misc_feature 1..21: note = n-mer motif encoding polynucleotide
  source 1..21: mol_type = other DNA
tataatacggatcggactaat

SEQ ID NO: 5240 - DNA, 21 bp, synthetic construct
  misc_feature 1..21: note = n-mer motif encoding polynucleotide
  source 1..21: mol_type = other DNA
gagaagcctcagcataatagt

SEQ ID NO: 5241 - DNA, 21 bp, synthetic construct
  misc_feature 1..21: note = n-mer motif encoding polynucleotide
  source 1..21: mol_type = other DNA
gcggcttatgagcatgcgcct

SEQ ID NO: 5242 - DNA, 21 bp, synthetic construct
  misc_feature 1..21: note = n-mer motif encoding polynucleotide
  source 1..21: mol_type = other DNA
ggcggcaactacaacacaact

SEQ ID NO: 5243 - DNA, 21 bp, synthetic construct
  misc_feature 1..21: note = n-mer motif encoding polynucleotide
  source 1..21: mol_type = other DNA
tatctgaatagtacgcagatt

SEQ ID NO: 5244 - DNA, 21 bp, synthetic construct
  misc_feature 1..21: note = n-mer motif encoding polynucleotide
  source 1..21: mol_type = other DNA
tctaattctaatactgctgct

SEQ ID NO: 5245 - DNA, 21 bp, synthetic construct
  misc_feature 1..21: note = n-mer motif encoding polynucleotide
  source 1..21: mol_type = other DNA
tcggataataggaatactgcg

SEQ ID NO: 5246 - DNA, 21 bp, synthetic construct
  misc_feature 1..21: note = n-mer motif encoding polynucleotide
  source 1..21: mol_type = other DNA
cgctcgttggacagcgggatg

SEQ ID NO: 5247 - DNA, 21 bp, synthetic construct
  misc_feature 1..21: note = n-mer motif encoding polynucleotide
  source 1..21: mol_type = other DNA
gttatggatacgcatgggatg

SEQ ID NO: 5248 - DNA, 21 bp, synthetic construct
  misc_feature 1..21: note = n-mer motif encoding polynucleotide
  source 1..21: mol_type = other DNA
catgttacggcggtggttgat

SEQ ID NO: 5249 - DNA, 21 bp, synthetic construct
  misc_feature 1..21: note = n-mer motif encoding polynucleotide
  source 1..21: mol_type = other DNA
agtatcacccacagcaacacc

SEQ ID NO: 5250 - DNA, 21 bp, synthetic construct
  misc_feature 1..21: note = n-mer motif encoding polynucleotide
  source 1..21: mol_type = other DNA
ggatacggcagttacagcaac

SEQ ID NO: 5251 - DNA, 21 bp, synthetic construct
  misc_feature 1..21: note = n-mer motif encoding polynucleotide
  source 1..21: mol_type = other DNA
cgttggtctgaaaacaactcc

SEQ ID NO: 5252 - DNA, 21 bp, synthetic construct
  misc_feature 1..21: note = n-mer motif encoding polynucleotide
  source 1..21: mol_type = other DNA
atgtctagccacaccgtccaa

SEQ ID NO: 5253 - DNA, 21 bp, synthetic construct
  misc_feature 1..21: note = n-mer motif encoding polynucleotide
  source 1..21: mol_type = other DNA
tatgttagggcgcaggatcag

SEQ ID NO: 5254 - DNA, 21 bp, synthetic construct
  misc_feature 1..21: note = n-mer motif encoding polynucleotide
  source 1..21: mol_type = other DNA
tttgagggtgataagacttat

SEQ ID NO: 5255 - DNA, 21 bp, synthetic construct
  misc_feature 1..21: note = n-mer motif encoding polynucleotide
  source 1..21: mol_type = other DNA
gttagctccggccacacgaaa

SEQ ID NO: 5256 - DNA, 21 bp, synthetic construct
  misc_feature 1..21: note = n-mer motif encoding polynucleotide
  source 1..21: mol_type = other DNA
tcgatgaacctgccaacttca

SEQ ID NO: 5257 - DNA, 21 bp, synthetic construct
  misc_feature 1..21: note = n-mer motif encoding polynucleotide
  source 1..21: mol_type = other DNA
ctgaatcctcagcatgagttg

SEQ ID NO: 5258 - DNA, 21 bp, synthetic construct
  misc_feature 1..21: note = n-mer motif encoding polynucleotide
  source 1..21: mol_type = other DNA
cttccgcctgcgtcggcgggt

SEQ ID NO: 5259 - DNA, 21 bp, synthetic construct
  misc_feature 1..21: note = n-mer motif encoding polynucleotide
  source 1..21: mol_type = other DNA
ggagggaactcccacggggta

SEQ ID NO: 5260 - DNA, 21 bp, synthetic construct
  misc_feature 1..21: note = n-mer motif encoding polynucleotide
  source 1..21: mol_type = other DNA
gggggtacggggttgtcgaag

SEQ ID NO: 5261 - DNA, 21 bp, synthetic construct
  misc_feature 1..21: note = n-mer motif encoding polynucleotide
  source 1..21: mol_type = other DNA
agtttgaattcttcgagtact

SEQ ID NO: 5262 - DNA, 21 bp, synthetic construct
  misc_feature 1..21: note = n-mer motif encoding polynucleotide
  source 1..21: mol_type = other DNA
atgcctagtgaaccaccaggg

SEQ ID NO: 5263 - DNA, 21 bp, synthetic construct
  misc_feature 1..21: note = n-mer motif encoding polynucleotide
  source 1..21: mol_type = other DNA
gttgtgcattcgagtattact

SEQ ID NO: 5264 - DNA, 21 bp, synthetic construct
  misc_feature 1..21: note = n-mer motif encoding polynucleotide
  source 1..21: mol_type = other DNA
ttgagtctggctgggaatagg

SEQ ID NO: 5265 - DNA, 21 bp, synthetic construct
  misc_feature 1..21: note = n-mer motif encoding polynucleotide
  source 1..21: mol_type = other DNA
gcggacatgcaacacaccgta

SEQ ID NO: 5266 - DNA, 21 bp, synthetic construct
  misc_feature 1..21: note = n-mer motif encoding polynucleotide
  source 1..21: mol_type = other DNA
tttcgtgatggtcagggtatg

SEQ ID NO: 5267 - DNA, 21 bp, synthetic construct
  misc_feature 1..21: note = n-mer motif encoding polynucleotide
  source 1..21: mol_type = other DNA
accggaacagcgatctcccga

SEQ ID NO: 5268 - DNA, 21 bp, synthetic construct
  misc_feature 1..21: note = n-mer motif encoding polynucleotide
  source 1..21: mol_type = other DNA
atggggaagcatgagggtctt

SEQ ID NO: 5269 - DNA, 21 bp, synthetic construct
  misc_feature 1..21: note = n-mer motif encoding polynucleotide
  source 1..21: mol_type = other DNA
ccggaatccgccgccaaaagc

SEQ ID NO: 5270 - DNA, 21 bp, synthetic construct
  misc_feature 1..21: note = n-mer motif encoding polynucleotide
  source 1..21: mol_type = other DNA
acccaagccttctccctaggc

SEQ ID NO: 5271 - DNA, 21 bp, synthetic construct
  misc_feature 1..21: note = n-mer motif encoding polynucleotide
  source 1..21: mol_type = other DNA
actgatggtatttttcagcct

SEQ ID NO: 5272 - DNA, 21 bp, synthetic construct
  misc_feature 1..21: note = n-mer motif encoding polynucleotide
  source 1..21: mol_type = other DNA
gggagcccagtgatagtaaac

SEQ ID NO: 5273 - DNA, 21 bp, synthetic construct
  misc_feature 1..21: note = n-mer motif encoding polynucleotide
  source 1..21: mol_type = other DNA
gggcgtgataatcatcatgcg

SEQ ID NO: 5274 - DNA, 21 bp, synthetic construct
  misc_feature 1..21: note = n-mer motif encoding polynucleotide
  source 1..21: mol_type = other DNA
ccgcgttctattacggagttg

SEQ ID NO: 5275 - DNA, 21 bp, synthetic construct
  misc_feature 1..21: note = n-mer motif encoding polynucleotide
  source 1..21: mol_type = other DNA
tgggtaaacagtgtgggcaac

SEQ ID NO: 5276 - DNA, 21 bp, synthetic construct
  misc_feature 1..21: note = n-mer motif encoding polynucleotide
  source 1..21: mol_type = other DNA
gttcatgggacgttgacttat

SEQ ID NO: 5277 - DNA, 21 bp, synthetic construct
  misc_feature 1..21: note = n-mer motif encoding polynucleotide
  source 1..21: mol_type = other DNA
ggtgtgtatattgatggtcgg

SEQ ID NO: 5278 - DNA, 21 bp, synthetic construct
  misc_feature 1..21: note = n-mer motif encoding polynucleotide
  source 1..21: mol_type = other DNA
atgagtaatgatttgcctggg

SEQ ID NO: 5279 - DNA, 21 bp, synthetic construct
  misc_feature 1..21: note = n-mer motif encoding polynucleotide
  source 1..21: mol_type = other DNA
aatcggtcggatagttttgcg

SEQ ID NO: 5280 - DNA, 21 bp, synthetic construct
  misc_feature 1..21: note = n-mer motif encoding polynucleotide
  source 1..21: mol_type = other DNA
gggcaaacaaacgcagtacac

SEQ ID NO: 5281 - DNA, 21 bp, synthetic construct
  misc_feature 1..21: note = n-mer motif encoding polynucleotide
  source 1..21: mol_type = other DNA
tacgtcgacaaatcaatgaca

SEQ ID NO: 5282 - DNA, 21 bp, synthetic construct
  misc_feature 1..21: note = n-mer motif encoding polynucleotide
  source 1..21: mol_type = other DNA
agtgtgatggtgggtacgaat

SEQ ID NO: 5283 - DNA, 21 bp, synthetic construct
  misc_feature 1..21: note = n-mer motif encoding polynucleotide
  source 1..21: mol_type = other DNA
attggtctgcagaattctact

SEQ ID NO: 5284 - DNA, 21 bp, synthetic construct
  misc_feature 1..21: note = n-mer motif encoding polynucleotide
  source 1..21: mol_type = other DNA
aacgaccgaccgcttgccagc

SEQ ID NO: 5285 - DNA, 21 bp, synthetic construct
  misc_feature 1..21: note = n-mer motif encoding polynucleotide
  source 1..21: mol_type = other DNA
ctcatgggcagtccaggcgcg

SEQ ID NO: 5286 - DNA, 21 bp, synthetic construct
  misc_feature 1..21: note = n-mer motif encoding polynucleotide
  source 1..21: mol_type = other DNA
attgatcgtagtgctagtttg

SEQ ID NO: 5287 - DNA, 21 bp, synthetic construct
  misc_feature 1..21: note = n-mer motif encoding polynucleotide
  source 1..21: mol_type = other DNA
attcaggcgaagaattctgag

SEQ ID NO: 5288 - DNA, 21 bp, synthetic construct
  misc_feature 1..21: note = n-mer motif encoding polynucleotide
  source 1..21: mol_type = other DNA
catcagtcttttgatgctggt

SEQ ID NO: 5289 - DNA, 21 bp, synthetic construct
  misc_feature 1..21: note = n-mer motif encoding polynucleotide
  source 1..21: mol_type = other DNA
gcggttaatgagactaggctt

SEQ ID NO: 5290 - DNA, 21 bp, synthetic construct
  misc_feature 1..21: note = n-mer motif encoding polynucleotide
  source 1..21: mol_type = other DNA
atcgcgtcaacgtggaacatg

SEQ ID NO: 5291 - DNA, 21 bp, synthetic construct
  misc_feature 1..21: note = n-mer motif encoding polynucleotide
  source 1..21: mol_type = other DNA
aaagtggacatgacctccaaa

SEQ ID NO: 5292 - DNA, 21 bp, synthetic construct
  misc_feature 1..21: note = n-mer motif encoding polynucleotide
  source 1..21: mol_type = other DNA
tctcatagtattacgggtctt

SEQ ID NO: 5293 - DNA, 21 bp, synthetic construct
  misc_feature 1..21: note = n-mer motif encoding polynucleotide
  source 1..21: mol_type = other DNA
actattactagtccgtcggtg

SEQ ID NO: 5294 - DNA, 21 bp, synthetic construct
  misc_feature 1..21: note = n-mer motif encoding polynucleotide
  source 1..21: mol_type = other DNA
gaacacatctctagctacgga

SEQ ID NO: 5295 - DNA, 21 bp, synthetic construct
  misc_feature 1..21: note = n-mer motif encoding polynucleotide
  source 1..21: mol_type = other DNA
ttctcaacaaactctgtaatc

SEQ ID NO: 5296 - DNA, 21 bp, synthetic construct
  misc_feature 1..21: note = n-mer motif encoding polynucleotide
  source 1..21: mol_type = other DNA
tcgatggagggtcagcagcat

SEQ ID NO: 5297 - DNA, 21 bp, synthetic construct
  misc_feature 1..21: note = n-mer motif encoding polynucleotide
  source 1..21: mol_type = other DNA
gtcgacaaaagcgaagccgtc

SEQ ID NO: 5298 - DNA, 21 bp, synthetic construct
  misc_feature 1..21: note = n-mer motif encoding polynucleotide
  source 1..21: mol_type = other DNA
caagctaacttatcaataatc

SEQ ID NO: 5299 - DNA, 21 bp, synthetic construct
  misc_feature 1..21: note = n-mer motif encoding polynucleotide
  source 1..21: mol_type = other DNA
gttaaggcgagtgctggggtt

SEQ ID NO: 5300 - DNA, 21 bp, synthetic construct
  misc_feature 1..21: note = n-mer motif encoding polynucleotide
  source 1..21: mol_type = other DNA
tttggtacttcttatacgact

SEQ ID NO: 5301 - DNA, 21 bp, synthetic construct
  misc_feature 1..21: note = n-mer motif encoding polynucleotide
  source 1..21: mol_type = other DNA
gggctcacaggatacccaatg

SEQ ID NO: 5302 - DNA, 21 bp, synthetic construct
  misc_feature 1..21: note = n-mer motif encoding polynucleotide
  source 1..21: mol_type = other DNA
gctatgggagcactcgtgcac

SEQ ID NO: 5303 - DNA, 21 bp, synthetic construct
  misc_feature 1..21: note = n-mer motif encoding polynucleotide
  source 1..21: mol_type = other DNA
gtatacgccaccgcactcgca

SEQ ID NO: 5304 - DNA, 21 bp, synthetic construct
  misc_feature 1..21: note = n-mer motif encoding polynucleotide
  source 1..21: mol_type = other DNA
acattaacagacgttcaccga

SEQ ID NO: 5305 - DNA, 21 bp, synthetic construct
  misc_feature 1..21: note = n-mer motif encoding polynucleotide
  source 1..21: mol_type = other DNA
ccatcctcagcgggtagcaca

SEQ ID NO: 5306 - DNA, 21 bp, synthetic construct
  misc_feature 1..21: note = n-mer motif encoding polynucleotide
  source 1..21: mol_type = other DNA
aaaaaacgaaaacactaacta

SEQ ID NO: 5307 - DNA, 21 bp, synthetic construct
  misc_feature 1..21: note = n-mer motif encoding polynucleotide
  source 1..21: mol_type = other DNA
gcttatcagctgactccggct

SEQ ID NO: 5308 - DNA, 21 bp, synthetic construct
  misc_feature 1..21: note = n-mer motif encoding polynucleotide
  source 1..21: mol_type = other DNA
cttgcgcctgataatattggg

SEQ ID NO: 5309 - DNA, 21 bp, synthetic construct
  misc_feature 1..21: note = n-mer motif encoding polynucleotide
  source 1..21: mol_type = other DNA
acaatcgtttccgcttacgcc

SEQ ID NO: 5310 - DNA, 21 bp, synthetic construct
  misc_feature 1..21: note = n-mer motif encoding polynucleotide
  source 1..21: mol_type = other DNA
ggtaataatttgagtttgtct

SEQ ID NO: 5311 - DNA, 21 bp, synthetic construct
  misc_feature 1..21: note = n-mer motif encoding polynucleotide
  source 1..21: mol_type = other DNA
agcacaaacaccgaacctagg

SEQ ID NO: 5312 - DNA, 21 bp, synthetic construct
  misc_feature 1..21: note = n-mer motif encoding polynucleotide
  source 1..21: mol_type = other DNA
tcttttcagacggatcgtgcg

SEQ ID NO: 5313 - DNA, 21 bp, synthetic construct
  misc_feature 1..21: note = n-mer motif encoding polynucleotide
  source 1..21: mol_type = other DNA
ttcttagaaggagtcgctcaa

SEQ ID NO: 5314 - DNA, 21 bp, synthetic construct
  misc_feature 1..21: note = n-mer motif encoding polynucleotide
  source 1..21: mol_type = other DNA
caagacgtaggacgcacgaac

SEQ ID NO: 5315 - DNA, 21 bp, synthetic construct
  misc_feature 1..21: note = n-mer motif encoding polynucleotide
  source 1..21: mol_type = other DNA
acgcatggtgatcatattcag

SEQ ID NO: 5316 - DNA, 21 bp, synthetic construct
  misc_feature 1..21: note = n-mer motif encoding polynucleotide
  source 1..21: mol_type = other DNA
gtatcagaaggacaacgaatc

SEQ ID NO: 5317 - DNA, 21 bp, synthetic construct
  misc_feature 1..21: note = n-mer motif encoding polynucleotide
  source 1..21: mol_type = other DNA
aacatgggtccaatgggccgg

SEQ ID NO: 5318 - DNA, 21 bp, synthetic construct
  misc_feature 1..21: note = n-mer motif encoding polynucleotide
  source 1..21: mol_type = other DNA
ctaccctcaacagaaactttg

SEQ ID NO: 5319 - DNA, 21 bp, synthetic construct
  misc_feature 1..21: note = n-mer motif encoding polynucleotide
  source 1..21: mol_type = other DNA
ggtggtatgtcggcgcattcg

SEQ ID NO: 5320 - DNA, 21 bp, synthetic construct
  misc_feature 1..21: note = n-mer motif encoding polynucleotide
  source 1..21: mol_type = other DNA
gggatgatcgggcacaacgca

SEQ ID NO: 5321 - DNA, 21 bp, synthetic construct
  misc_feature 1..21: note = n-mer motif encoding polynucleotide
  source 1..21: mol_type = other DNA
atagacgaacgttcctcgata

SEQ ID NO: 5322 - DNA, 21 bp, synthetic construct
  misc_feature 1..21: note = n-mer motif encoding polynucleotide
  source 1..21: mol_type = other DNA
catgtgaatcctacgccggcg

SEQ ID NO: 5323 - DNA, 21 bp, synthetic construct
  misc_feature 1..21: note = n-mer motif encoding polynucleotide
  source 1..21: mol_type = other DNA
tggtcgagaactggaaacacc

SEQ ID NO: 5324 - DNA, 21 bp, synthetic construct
  misc_feature 1..21: note = n-mer motif encoding polynucleotide
  source 1..21: mol_type = other DNA
atcaaagactcgtaccttact

SEQ ID NO: 5325 - DNA, 21 bp, synthetic construct
  misc_feature 1..21: note = n-mer motif encoding polynucleotide
  source 1..21: mol_type = other DNA
ttgaaccaaaacagtgtctcc

SEQ ID NO: 5326 - DNA, 21 bp, synthetic construct
  misc_feature 1..21: note = n-mer motif encoding polynucleotide
  source 1..21: mol_type = other DNA
tctggtccgattcctgctgtt

SEQ ID NO: 5327 - DNA, 21 bp, synthetic construct
  misc_feature 1..21: note = n-mer motif encoding polynucleotide
  source 1..21: mol_type = other DNA
atgcaagggcttaacaacatg

SEQ ID NO: 5328 - DNA, 21 bp, synthetic construct
  misc_feature 1..21: note = n-mer motif encoding polynucleotide
  source 1..21: mol_type = other DNA
tcaaacagcggaggcaaccac

SEQ ID NO: 5329 - DNA, 21 bp, synthetic construct
  misc_feature 1..21: note = n-mer motif encoding polynucleotide
  source 1..21: mol_type = other DNA
acgagtacgatgactgcgcgt

SEQ ID NO: 5330 - DNA, 21 bp, synthetic construct
  misc_feature 1..21: note = n-mer motif encoding polynucleotide
  source 1..21: mol_type = other DNA
gagaatagtgatttgtcttat

SEQ ID NO: 5331 - DNA, 21 bp, synthetic construct
  misc_feature 1..21: note = n-mer motif encoding polynucleotide
  source 1..21: mol_type = other DNA
catcctgggaatagttctgtg

SEQ ID NO: 5332 - DNA, 21 bp, synthetic construct
  misc_feature 1..21: note = n-mer motif encoding polynucleotide
  source 1..21: mol_type = other DNA
ttaacaccccaagggactagt

SEQ ID NO: 5333 - DNA, 21 bp, synthetic construct
  misc_feature 1..21: note = n-mer motif encoding polynucleotide
  source 1..21: mol_type = other DNA
accgacacccgaaaaaacgac

SEQ ID NO: 5334 - DNA, 21 bp, synthetic construct
  misc_feature 1..21: note = n-mer motif encoding polynucleotide
  source 1..21: mol_type = other DNA
ggggagacgctgaggtctcag

SEQ ID NO: 5335 - DNA, 21 bp, synthetic construct
  misc_feature 1..21: note = n-mer motif encoding polynucleotide
  source 1..21: mol_type = other DNA
agcggtgtatcagaaggaaac

SEQ ID NO: 5336 - DNA, 21 bp, synthetic construct
  misc_feature 1..21: note = n-mer motif encoding polynucleotide
  source 1..21: mol_type = other DNA
actcagtatggtactctgccg

SEQ ID NO: 5337 - DNA, 21 bp, synthetic construct
  misc_feature 1..21: note = n-mer motif encoding polynucleotide
  source 1..21: mol_type = other DNA
gggacggttaactcaagtgca

SEQ ID NO: 5338 - DNA, 21 bp, synthetic construct
  misc_feature 1..21: note = n-mer motif encoding polynucleotide
  source 1..21: mol_type = other DNA
ggtaaagcaaccttagtcctc

SEQ ID NO: 5339 - DNA, 21 bp, synthetic construct
  misc_feature 1..21: note = n-mer motif encoding polynucleotide
  source 1..21: mol_type = other DNA
ggtatatacccggcatccacc

SEQ ID NO: 5340 - DNA, 21 bp, synthetic construct
  misc_feature 1..21: note = n-mer motif encoding polynucleotide
  source 1..21: mol_type = other DNA
ggtgttatgtctaatgctact

SEQ ID NO: 5341 - DNA, 21 bp, synthetic construct
  misc_feature 1..21: note = n-mer motif encoding polynucleotide
  source 1..21: mol_type = other DNA
actcatgtgattggggctgtg

SEQ ID NO: 5342 - DNA, 21 bp, synthetic construct
  misc_feature 1..21: note = n-mer motif encoding polynucleotide
  source 1..21: mol_type = other DNA
actcggagtgatattggtgtg

SEQ ID NO: 5343 - DNA, 21 bp, synthetic construct
  misc_feature 1..21: note = n-mer motif encoding polynucleotide
  source 1..21: mol_type = other DNA
acgcttacattatctaccctc

SEQ ID NO: 5344 - DNA, 21 bp, synthetic construct
  misc_feature 1..21: note = n-mer motif encoding polynucleotide
  source 1..21: mol_type = other DNA
tataatgagtcttcgaatgcg

SEQ ID NO: 5345 - DNA, 21 bp, synthetic construct
  misc_feature 1..21: note = n-mer motif encoding polynucleotide
  source 1..21: mol_type = other DNA
tcgacgcaggcgcagaccggc

SEQ ID NO: 5346 - DNA, 21 bp, synthetic construct
  misc_feature 1..21: note = n-mer motif encoding polynucleotide
  source 1..21: mol_type = other DNA
cgcgacatgatcaactcatca

SEQ ID NO: 5347 - DNA, 21 bp, synthetic construct
  misc_feature 1..21: note = n-mer motif encoding polynucleotide
  source 1..21: mol_type = other DNA
actaagggtaataatctggtt

SEQ ID NO: 5348 - DNA, 21 bp, synthetic construct
  misc_feature 1..21: note = n-mer motif encoding polynucleotide
  source 1..21: mol_type = other DNA
ggttctacggtgtcggcgcag

SEQ ID NO: 5349 - DNA, 21 bp, synthetic construct
  misc_feature 1..21: note = n-mer motif encoding polynucleotide
  source 1..21: mol_type = other DNA
aggggtgatactatgaattat

SEQ ID NO: 5350 - DNA, 21 bp, synthetic construct
  misc_feature 1..21: note = n-mer motif encoding polynucleotide
  source 1..21: mol_type = other DNA
catgcggatgtgaatgctggg

SEQ ID NO: 5351 - DNA, 21 bp, synthetic construct
  misc_feature 1..21: note = n-mer motif encoding polynucleotide
  source 1..21: mol_type = other DNA
agcgttgtcaacaccaacatc

SEQ ID NO: 5352 - DNA, 21 bp, synthetic construct
  misc_feature 1..21: note = n-mer motif encoding polynucleotide
  source 1..21: mol_type = other DNA
tctaatgttcatgttgttaat

SEQ ID NO: 5353 - DNA, 21 bp, synthetic construct
  misc_feature 1..21: note = n-mer motif encoding polynucleotide
  source 1..21: mol_type = other DNA
tcggttgataagccgccgggg

SEQ ID NO: 5354 - DNA, 21 bp, synthetic construct
  misc_feature 1..21: note = n-mer motif encoding polynucleotide
  source 1..21: mol_type = other DNA
gaccgcacctactcaaacaca

SEQ ID NO: 5355 - DNA, 21 bp, synthetic construct
  misc_feature 1..21: note = n-mer motif encoding polynucleotide
  source 1..21: mol_type = other DNA
tactccggagaactaaacaaa

SEQ ID NO: 5356 - DNA, 21 bp, synthetic construct
  misc_feature 1..21: note = n-mer motif encoding polynucleotide
  source 1..21: mol_type = other DNA
tatgataagactttgagtgtt

SEQ ID NO: 5357 - DNA, 21 bp, synthetic construct
  misc_feature 1..21: note = n-mer motif encoding polynucleotide
  source 1..21: mol_type = other DNA
cacaccgccacccttagcagc

SEQ ID NO: 5358 - DNA, 21 bp, synthetic construct
  misc_feature 1..21: note = n-mer motif encoding polynucleotide
  source 1..21: mol_type = other DNA
gctctggagagggctcagtat

SEQ ID NO: 5359 - DNA, 21 bp, synthetic construct
  misc_feature 1..21: note = n-mer motif encoding polynucleotide
  source 1..21: mol_type = other DNA
ggtacgagtgataattatagg

SEQ ID NO: 5360 - DNA, 21 bp, synthetic construct
  misc_feature 1..21: note = n-mer motif encoding polynucleotide
  source 1..21: mol_type = other DNA
catgtgaatagtagggatctt

SEQ ID NO: 5361 - DNA, 21 bp, synthetic construct
  misc_feature 1..21: note = n-mer motif encoding polynucleotide
  source 1..21: mol_type = other DNA
tcgtcagacgttaccagacaa

SEQ ID NO: 5362 - DNA, 21 bp, synthetic construct
  misc_feature 1..21: note = n-mer motif encoding polynucleotide
  source 1..21: mol_type = other DNA
gctcatcatatgacgacggag

SEQ ID NO: 5363 - DNA, 21 bp, synthetic construct
  misc_feature 1..21: note = n-mer motif encoding polynucleotide
  source 1..21: mol_type = other DNA
gaggtgtctagggatggtctg

SEQ ID NO: 5364 - DNA, 21 bp, synthetic construct
  misc_feature 1..21: note = n-mer motif encoding polynucleotide
  source 1..21: mol_type = other DNA
gtgggccgtgacgcagaagct

SEQ ID NO: 5365 - DNA, 21 bp, synthetic construct
  misc_feature 1..21: note = n-mer motif encoding polynucleotide
  source 1..21: mol_type = other DNA
gcacaccaaaaagacctacgc

SEQ ID NO: 5366 - DNA, 21 bp, synthetic construct
  misc_feature 1..21: note = n-mer motif encoding polynucleotide
  source 1..21: mol_type = other DNA
agtgttctgagtagttcgact

SEQ ID NO: 5367 - DNA, 21 bp, synthetic construct
  misc_feature 1..21: note = n-mer motif encoding polynucleotide
  source 1..21: mol_type = other DNA
ctgggtacgctgcttagtcag

SEQ ID NO: 5368 - DNA, 21 bp, synthetic construct
  misc_feature 1..21: note = n-mer motif encoding polynucleotide
  source 1..21: mol_type = other DNA
tcacaaaaaccaatcgacgac

SEQ ID NO: 5369 - DNA, 21 bp, synthetic construct
  misc_feature 1..21: note = n-mer motif encoding polynucleotide
  source 1..21: mol_type = other DNA
gataatgtgcatgggcaggtg

SEQ ID NO: 5370 - DNA, 21 bp, synthetic construct
  misc_feature 1..21: note = n-mer motif encoding polynucleotide
  source 1..21: mol_type = other DNA
ggttcgcacaacgggccgaca

SEQ ID NO: 5371 - DNA, 21 bp, synthetic construct
  misc_feature 1..21: note = n-mer motif encoding polynucleotide
  source 1..21: mol_type = other DNA
atctccggtagtagcagtcta

SEQ ID NO: 5372 - DNA, 21 bp, synthetic construct
  misc_feature 1..21: note = n-mer motif encoding polynucleotide
  source 1..21: mol_type = other DNA
ggttttcatattaatggtgag

SEQ ID NO: 5373 - DNA, 21 bp, synthetic construct
  misc_feature 1..21: note = n-mer motif encoding polynucleotide
  source 1..21: mol_type = other DNA
atgagtgatgggcattcgaag

SEQ ID NO: 5374 - DNA, 21 bp, synthetic construct
  misc_feature 1..21: note = n-mer motif encoding polynucleotide
  source 1..21: mol_type = other DNA
actgttggtggtaatcatcat

SEQ ID NO: 5375 - DNA, 21 bp, synthetic construct
  misc_feature 1..21: note = n-mer motif encoding polynucleotide
  source 1..21: mol_type = other DNA
aatgctactccgccgaatcat

SEQ ID NO: 5376 - DNA, 21 bp, synthetic construct
  misc_feature 1..21: note = n-mer motif encoding polynucleotide
  source 1..21: mol_type = other DNA
acgggtatgaatagtaataag

SEQ ID NO: 5377 - DNA, 21 bp, synthetic construct
  misc_feature 1..21: note = n-mer motif encoding polynucleotide
  source 1..21: mol_type = other DNA
atcgaagcctactcacgagac

SEQ ID NO: 5378 - DNA, 21 bp, synthetic construct
  misc_feature 1..21: note = n-mer motif encoding polynucleotide
  source 1..21: mol_type = other DNA
cgcgaccgtcaagactcggta

SEQ ID NO: 5379 - DNA, 21 bp, synthetic construct
  misc_feature 1..21: note = n-mer motif encoding polynucleotide
  source 1..21: mol_type = other DNA
cacacggttcaaatacgcgaa

SEQ ID NO: 5380 - DNA, 21 bp, synthetic construct
  misc_feature 1..21: note = n-mer motif encoding polynucleotide
  source 1..21: mol_type = other DNA
actttgacgcagactgggatg

SEQ ID NO: 5381 - DNA, 21 bp, synthetic construct
  misc_feature 1..21: note = n-mer motif encoding polynucleotide
  source 1..21: mol_type = other DNA
attaataattttaatactctg

SEQ ID NO: 5382 - DNA, 21 bp, synthetic construct
  misc_feature 1..21: note = n-mer motif encoding polynucleotide
  source 1..21: mol_type = other DNA
gtagccgcgggaccagaagcg

SEQ ID NO: 5383 - DNA, 21 bp, synthetic construct
  misc_feature 1..21: note = n-mer motif encoding polynucleotide
  source 1..21: mol_type = other DNA
gatggtaagaatagttatgcg

SEQ ID NO: 5384 - DNA, 21 bp, synthetic construct
  misc_feature 1..21: note = n-mer motif encoding polynucleotide
  source 1..21: mol_type = other DNA
tccaggcaagaaaacttctcc

SEQ ID NO: 5385 - DNA, 21 bp, synthetic construct
  misc_feature 1..21: note = n-mer motif encoding polynucleotide
  source 1..21: mol_type = other DNA
tctaacagcagtgttgcggta

SEQ ID NO: 5386 - DNA, 21 bp, synthetic construct
  misc_feature 1..21: note = n-mer motif encoding polynucleotide
  source 1..21: mol_type = other DNA
gatcatagtaagcagagttcg

SEQ ID NO: 5387 - DNA, 21 bp, synthetic construct
  misc_feature 1..21: note = n-mer motif encoding polynucleotide
  source 1..21: mol_type = other DNA
ttgagtggtgctggtagtcag

SEQ ID NO: 5388 - DNA, 21 bp, synthetic construct
  misc_feature 1..21: note = n-mer motif encoding polynucleotide
  source 1..21: mol_type = other DNA
ggttggagtaataatgagttg

SEQ ID NO: 5389 - DNA, 21 bp, synthetic construct
  misc_feature 1..21: note = n-mer motif encoding polynucleotide
  source 1..21: mol_type = other DNA
ctaatacgaggttccatggaa

SEQ ID NO: 5390 - DNA, 21 bp, synthetic construct
  misc_feature 1..21: note = n-mer motif encoding polynucleotide
  source 1..21: mol_type = other DNA
aatacttatactgctggtaag

SEQ ID NO: 5391 - DNA, 21 bp, synthetic construct
  misc_feature 1..21: note = n-mer motif encoding polynucleotide
  source 1..21: mol_type = other DNA
actcgtggcgacatggaattc

SEQ ID NO: 5392 - DNA, 21 bp, synthetic construct
  misc_feature 1..21: note = n-mer motif encoding polynucleotide
  source 1..21: mol_type = other DNA
ctcatgtcagggaaagaaaac

SEQ ID NO: 5393 - DNA, 21 bp, synthetic construct
  misc_feature 1..21: note = n-mer motif encoding polynucleotide
  source 1..21: mol_type = other DNA
aaggatactaatcagcagatt

SEQ ID NO: 5394 - DNA, 21 bp, synthetic construct
  misc_feature 1..21: note = n-mer motif encoding polynucleotide
  source 1..21: mol_type = other DNA
cacaacgtcggcctaggacac

SEQ ID NO: 5395 - DNA, 21 bp, synthetic construct
  misc_feature 1..21: note = n-mer motif encoding polynucleotide
  source 1..21: mol_type = other DNA
cctgatcagcctggtccttct

SEQ ID NO: 5396 - DNA, 21 bp, synthetic construct
  misc_feature 1..21: note = n-mer motif encoding polynucleotide
  source 1..21: mol_type = other DNA
atgcaaagagaagcagccaac

SEQ ID NO: 5397 - DNA, 21 bp, synthetic construct
  misc_feature 1..21: note = n-mer motif encoding polynucleotide
  source 1..21: mol_type = other DNA
gggcagcgtacgacgaatgat

SEQ ID NO: 5398 - DNA, 21 bp, synthetic construct
  misc_feature 1..21: note = n-mer motif encoding polynucleotide
  source 1..21: mol_type = other DNA
aaacacacagaaaacgggacc

SEQ ID NO: 5399 - DNA, 21 bp, synthetic construct
  misc_feature 1..21: note = n-mer motif encoding polynucleotide
  source 1..21: mol_type = other DNA
ttagacgtgacgagaatgaga

SEQ ID NO: 5400 - DNA, 21 bp, synthetic construct
  misc_feature 1..21: note = n-mer motif encoding polynucleotide
  source 1..21: mol_type = other DNA
acgttggatcggaatcagact

SEQ ID NO: 5401 - DNA, 21 bp, synthetic construct
  misc_feature 1..21: note = n-mer motif encoding polynucleotide
  source 1..21: mol_type = other DNA
atcaacgccggcaactaccga

SEQ ID NO: 5402 - DNA, 21 bp, synthetic construct
  misc_feature 1..21: note = n-mer motif encoding polynucleotide
  source 1..21: mol_type = other DNA
gccgtagaccaatcacgtttg

SEQ ID NO: 5403 - DNA, 21 bp, synthetic construct
  misc_feature 1..21: note = n-mer motif encoding polynucleotide
  source 1..21: mol_type = other DNA
gctcttgggcatcaggggaat

SEQ ID NO: 5404 - DNA, 21 bp, synthetic construct
  misc_feature 1..21: note = n-mer motif encoding polynucleotide
  source 1..21: mol_type = other DNA
cttccgcgtcatgatcagtat

SEQ ID NO: 5405 - DNA, 21 bp, synthetic construct
  misc_feature 1..21: note = n-mer motif encoding polynucleotide
  source 1..21: mol_type = other DNA
atttctgggtcgtcgtctctt

SEQ ID NO: 5406 - DNA, 21 bp, synthetic construct
  misc_feature 1..21: note = n-mer motif encoding polynucleotide
  source 1..21: mol_type = other DNA
tggaatacgaatatggcgatt

SEQ ID NO: 5407 - DNA, 21 bp, synthetic construct
  misc_feature 1..21: note = n-mer motif encoding polynucleotide
  source 1..21: mol_type = other DNA
atgtcggatcgtacttctgat

SEQ ID NO: 5408 - DNA, 21 bp, synthetic construct
  misc_feature 1..21: note = n-mer motif encoding polynucleotide
  source 1..21: mol_type = other DNA
acaagggaatcaatgtccatc

SEQ ID NO: 5409 - DNA, 21 bp, synthetic construct
  misc_feature 1..21: note = n-mer motif encoding polynucleotide
  source 1..21: mol_type = other DNA
cagcggggggagcttcctgcg

SEQ ID NO: 5410 - DNA, 21 bp, synthetic construct
  misc_feature 1..21: note = n-mer motif encoding polynucleotide
  source 1..21: mol_type = other DNA
tcgtctgatcctaaggggcag

SEQ ID NO: 5411 - DNA, 21 bp, synthetic construct
  misc_feature 1..21: note = n-mer motif encoding polynucleotide
  source 1..21: mol_type = other DNA
ccgagtgataggactacttat

SEQ ID NO: 5412 - DNA, 21 bp, synthetic construct
  misc_feature 1..21: note = n-mer motif encoding polynucleotide
  source 1..21: mol_type = other DNA
tcttcttctgatagtccgcgt

SEQ ID NO: 5413 - DNA, 21 bp, synthetic construct
  misc_feature 1..21: note = n-mer motif encoding polynucleotide
  source 1..21: mol_type = other DNA
gtattacactctgtatcagca

SEQ ID NO: 5414 - DNA, 21 bp, synthetic construct
  misc_feature 1..21: note = n-mer motif encoding polynucleotide
  source 1..21: mol_type = other DNA
agtatgcaatcatacaccatg

SEQ ID NO: 5415 - DNA, 21 bp, synthetic construct
  misc_feature 1..21: note = n-mer motif encoding polynucleotide
  source 1..21: mol_type = other DNA
tctctgcaactcacagcgggt

SEQ ID NO: 5416 - DNA, 21 bp, synthetic construct
  misc_feature 1..21: note = n-mer motif encoding polynucleotide
  source 1..21: mol_type = other DNA
aacaacgtaaacccgtactcg

SEQ ID NO: 5417 - DNA, 21 bp, synthetic construct
  misc_feature 1..21: note = n-mer motif encoding polynucleotide
  source 1..21: mol_type = other DNA
cttgcgaatggtatgacggct

SEQ ID NO: 5418 - DNA, 21 bp, synthetic construct
  misc_feature 1..21: note = n-mer motif encoding polynucleotide
  source 1..21: mol_type = other DNA
ggaatcacaggatcaacagga

SEQ ID NO: 5419 - DNA, 21 bp, synthetic construct
  misc_feature 1..21: note = n-mer motif encoding polynucleotide
  source 1..21: mol_type = other DNA
atgcttgttcagaatactcct

SEQ ID NO: 5420 - DNA, 21 bp, synthetic construct
  misc_feature 1..21: note = n-mer motif encoding polynucleotide
  source 1..21: mol_type = other DNA
gatgcgaatgcgggtacgagg

SEQ ID NO: 5421 - DNA, 21 bp, synthetic construct
  misc_feature 1..21: note = n-mer motif encoding polynucleotide
  source 1..21: mol_type = other DNA
gaaaccggagctatgacctct

SEQ ID NO: 5422 - DNA, 21 bp, synthetic construct
  misc_feature 1..21: note = n-mer motif encoding polynucleotide
  source 1..21: mol_type = other DNA
atacaaactactacaaaatgc

SEQ ID NO: 5423 - DNA, 21 bp, synthetic construct
  misc_feature 1..21: note = n-mer motif encoding polynucleotide
  source 1..21: mol_type = other DNA
gcgcagcagagtcttcatggt

SEQ ID NO: 5424 - DNA, 21 bp, synthetic construct
  misc_feature 1..21: note = n-mer motif encoding polynucleotide
  source 1..21: mol_type = other DNA
attgatagtacttggaatacg

SEQ ID NO: 5425 - DNA, 21 bp, synthetic construct
  misc_feature 1..21: note = n-mer motif encoding polynucleotide
  source 1..21: mol_type = other DNA
accgaatcgcaaaccatgagg

SEQ ID NO: 5426 - DNA, 21 bp, synthetic construct
  misc_feature 1..21: note = n-mer motif encoding polynucleotide
  source 1..21: mol_type = other DNA
ttgatccaaacgcaaggcacg

SEQ ID NO: 5427 - DNA, 21 bp, synthetic construct
  misc_feature 1..21: note = n-mer motif encoding polynucleotide
  source 1..21: mol_type = other DNA
atagtaaacataactcaatcg

SEQ ID NO: 5428 - DNA, 21 bp, synthetic construct
  misc_feature 1..21: note = n-mer motif encoding polynucleotide
  source 1..21: mol_type = other DNA
gtggcggtgtctaatacgcct

SEQ ID NO: 5429 - DNA, 21 bp, synthetic construct
  misc_feature 1..21: note = n-mer motif encoding polynucleotide
  source 1..21: mol_type = other DNA
ggtcatagggattcgggtggt

SEQ ID NO: 5430 - DNA, 21 bp, synthetic construct
  misc_feature 1..21: note = n-mer motif encoding polynucleotide
  source 1..21: mol_type = other DNA
cggaatgagaatcttaataat

SEQ ID NO: 5431 - DNA, 21 bp, synthetic construct
  misc_feature 1..21: note = n-mer motif encoding polynucleotide
  source 1..21: mol_type = other DNA
gtcatgcaacgatctgcacaa

SEQ ID NO: 5432 - DNA, 21 bp, synthetic construct
  misc_feature 1..21: note = n-mer motif encoding polynucleotide
  source 1..21: mol_type = other DNA
gtctcgggtccggtatcggtc

SEQ ID NO: 5433 - DNA, 21 bp, synthetic construct
  misc_feature 1..21: note = n-mer motif encoding polynucleotide
  source 1..21: mol_type = other DNA
ggggatattcagagtcatagt

SEQ ID NO: 5434 - DNA, 21 bp, synthetic construct
  misc_feature 1..21: note = n-mer motif encoding polynucleotide
  source 1..21: mol_type = other DNA
gttgagaagcctctggagact

SEQ ID NO: 5435 - DNA, 21 bp, synthetic construct
  misc_feature 1..21: note = n-mer motif encoding polynucleotide
  source 1..21: mol_type = other DNA
ggtgttcagatgactgcgggg

SEQ ID NO: 5436 - DNA, 21 bp, synthetic construct
  misc_feature 1..21: note = n-mer motif encoding polynucleotide
  source 1..21: mol_type = other DNA
accacaaaaacgacatctatg

SEQ ID NO: 5437 - DNA, 21 bp, synthetic construct
  misc_feature 1..21: note = n-mer motif encoding polynucleotide
  source 1..21: mol_type = other DNA
cctgggaatccgtctagtaat

SEQ ID NO: 5438 - DNA, 21 bp, synthetic construct
  misc_feature 1..21: note = n-mer motif encoding polynucleotide
  source 1..21: mol_type = other DNA
gcttcgcggcctgcggctcag

SEQ ID NO: 5439 - DNA, 21 bp, synthetic construct
  misc_feature 1..21: note = n-mer motif encoding polynucleotide
  source 1..21: mol_type = other DNA
gttcatgatcagggggctggg

SEQ ID NO: 5440 - DNA, 21 bp, synthetic construct
  misc_feature 1..21: note = n-mer motif encoding polynucleotide
  source 1..21: mol_type = other DNA
tcaggttcggaataccgtacc

SEQ ID NO: 5441 - DNA, 21 bp, synthetic construct
  misc_feature 1..21: note = n-mer motif encoding polynucleotide
  source 1..21: mol_type = other DNA
tacgtggacgacaacagtcgc

SEQ ID NO: 5442 - DNA, 21 bp, synthetic construct
  misc_feature 1..21: note = n-mer motif encoding polynucleotide
  source 1..21: mol_type = other DNA
atggccggtgaccaagaactc

SEQ ID NO: 5443 - DNA, 21 bp, synthetic construct
  misc_feature 1..21: note = n-mer motif encoding polynucleotide
  source 1..21: mol_type = other DNA
cctttgcacaacatacctcct

SEQ ID NO: 5444 - DNA, 21 bp, synthetic construct
  misc_feature 1..21: note = n-mer motif encoding polynucleotide
  source 1..21: mol_type = other DNA
agtgggattggtacttattct

SEQ ID NO: 5445 - DNA, 21 bp, synthetic construct
  misc_feature 1..21: note = n-mer motif encoding polynucleotide
  source 1..21: mol_type = other DNA
tcgaacgcagacatcctcgcc

SEQ ID NO: 5446 - DNA, 21 bp, synthetic construct
  misc_feature 1..21: note = n-mer motif encoding polynucleotide
  source 1..21: mol_type = other DNA
agtcacaaccaagtaaacgta

SEQ ID NO: 5447 - DNA, 21 bp, synthetic construct
  misc_feature 1..21: note = n-mer motif encoding polynucleotide
  source 1..21: mol_type = other DNA
cagcattctccgaagccggtt

SEQ ID NO: 5448 - DNA, 21 bp, synthetic construct
  misc_feature 1..21: note = n-mer motif encoding polynucleotide
  source 1..21: mol_type = other DNA
tccgcaaacaacatagccccc

SEQ ID NO: 5449 - DNA, 21 bp, synthetic construct
  misc_feature 1..21: note = n-mer motif encoding polynucleotide
  source 1..21: mol_type = other DNA
gaagaaacacggaccagaatg

SEQ ID NO: 5450 - DNA, 21 bp, synthetic construct
  misc_feature 1..21: note = n-mer motif encoding polynucleotide
  source 1..21: mol_type = other DNA
ctgtctaattcgattacgcct

SEQ ID NO: 5451 - DNA, 21 bp, synthetic construct
  misc_feature 1..21: note = n-mer motif encoding polynucleotide
  source 1..21: mol_type = other DNA
agtgctttgaatagtgtggat

SEQ ID NO: 5452 - DNA, 21 bp, synthetic construct
  misc_feature 1..21: note = n-mer motif encoding polynucleotide
  source 1..21: mol_type = other DNA
actaatcttgctgttacgctg

SEQ ID NO: 5453 - DNA, 21 bp, synthetic construct
  misc_feature 1..21: note = n-mer motif encoding polynucleotide
  source 1..21: mol_type = other DNA
cagtcgacgctgaataggcct

SEQ ID NO: 5454 - DNA, 21 bp, synthetic construct
  misc_feature 1..21: note = n-mer motif encoding polynucleotide
  source 1..21: mol_type = other DNA
atagaacacatgcttagaccc

SEQ ID NO: 5455 - DNA, 21 bp, synthetic construct
  misc_feature 1..21: note = n-mer motif encoding polynucleotide
  source 1..21: mol_type = other DNA
ccgactcctaatgagcatatg

SEQ ID NO: 5456 - DNA, 21 bp, synthetic construct
  misc_feature 1..21: note = n-mer motif encoding polynucleotide
  source 1..21: mol_type = other DNA
attaatgagattggtaggatg

SEQ ID NO: 5457 - DNA, 21 bp, synthetic construct
  misc_feature 1..21: note = n-mer motif encoding polynucleotide
  source 1..21: mol_type = other DNA
aacaacgacaacgtctacgtg

SEQ ID NO: 5458 - DNA, 21 bp, synthetic construct
  misc_feature 1..21: note = n-mer motif encoding polynucleotide
  source 1..21: mol_type = other DNA
atagtccacaccccgcaagtg

SEQ ID NO: 5459 - DNA, 21 bp, synthetic construct
  misc_feature 1..21: note = n-mer motif encoding polynucleotide
  source 1..21: mol_type = other DNA
cataagagtgagagtcataat

SEQ ID NO: 5460 - DNA, 21 bp, synthetic construct
  misc_feature 1..21: note = n-mer motif encoding polynucleotide
  source 1..21: mol_type = other DNA
tcatcgtcagactcacccaga

SEQ ID NO: 5461 - DNA, 21 bp, synthetic construct
  misc_feature 1..21: note = n-mer motif encoding polynucleotide
  source 1..21: mol_type = other DNA
tactctacagaagcacgagtc

SEQ ID NO: 5462 - DNA, 21 bp, synthetic construct
  misc_feature 1..21: note = n-mer motif encoding polynucleotide
  source 1..21: mol_type = other DNA
acctcgggtgaccggtacacg

SEQ ID NO: 5463 - DNA, 21 bp, synthetic construct
  misc_feature 1..21: note = n-mer motif encoding polynucleotide
  source 1..21: mol_type = other DNA
gagaagaatctgactaatgct

SEQ ID NO: 5464 - DNA, 21 bp, synthetic construct
  misc_feature 1..21: note = n-mer motif encoding polynucleotide
  source 1..21: mol_type = other DNA
acaagggaccaaaggtctaca

SEQ ID NO: 5465 - DNA, 21 bp, synthetic construct
  misc_feature 1..21: note = n-mer motif encoding polynucleotide
  source 1..21: mol_type = other DNA
gcgactgataagatgactcct

SEQ ID NO: 5466 - DNA, 21 bp, synthetic construct
  misc_feature 1..21: note = n-mer motif encoding polynucleotide
  source 1..21: mol_type = other DNA
aatagttatactgctgggaag

SEQ ID NO: 5467 - DNA, 21 bp, synthetic construct
  misc_feature 1..21: note = n-mer motif encoding polynucleotide
  source 1..21: mol_type = other DNA
acgctggatactaaggatctt

SEQ ID NO: 5468 - DNA, 21 bp, synthetic construct
  misc_feature 1..21: note = n-mer motif encoding polynucleotide
  source 1..21: mol_type = other DNA
gcatccaacgggcaagttaac

SEQ ID NO: 5469 - DNA, 21 bp, synthetic construct
  misc_feature 1..21: note = n-mer motif encoding polynucleotide
  source 1..21: mol_type = other DNA
acctcaatatcgtcgcaaagc

SEQ ID NO: 5470 - DNA, 21 bp, synthetic construct
  misc_feature 1..21: note = n-mer motif encoding polynucleotide
  source 1..21: mol_type = other DNA
gataatagtcctgctaatcat

SEQ ID NO: 5471 - DNA, 21 bp, synthetic construct
  misc_feature 1..21: note = n-mer motif encoding polynucleotide
  source 1..21: mol_type = other DNA
aactccagggaaatgggtgta

SEQ ID NO: 5472 - DNA, 21 bp, synthetic construct
  misc_feature 1..21: note = n-mer motif encoding polynucleotide
  source 1..21: mol_type = other DNA
accagcgcgtctgaaaactgg

SEQ ID NO: 5473 - DNA, 21 bp, synthetic construct
  misc_feature 1..21: note = n-mer motif encoding polynucleotide
  source 1..21: mol_type = other DNA
actgtaggatcctcatacgct

SEQ ID NO: 5474 - DNA, 21 bp, synthetic construct
  misc_feature 1..21: note = n-mer motif encoding polynucleotide
  source 1..21: mol_type = other DNA
caacaatcacaaaactctata

SEQ ID NO: 5475 - DNA, 21 bp, synthetic construct
  misc_feature 1..21: note = n-mer motif encoding polynucleotide
  source 1..21: mol_type = other DNA
cttcgggatgggattgcttct

SEQ ID NO: 5476 - DNA, 21 bp, synthetic construct
  misc_feature 1..21: note = n-mer motif encoding polynucleotide
  source 1..21: mol_type = other DNA
gtgcaaaaaacgacggcttgg

SEQ ID NO: 5477 - DNA, 21 bp, synthetic construct
  misc_feature 1..21: note = n-mer motif encoding polynucleotide
  source 1..21: mol_type = other DNA
atgagtacggttcttcgggag

SEQ ID NO: 5478 - DNA, 21 bp, synthetic construct
  misc_feature 1..21: note = n-mer motif encoding polynucleotide
  source 1..21: mol_type = other DNA
agtatggatgctcggttgacg

SEQ ID NO: 5479 - DNA, 21 bp, synthetic construct
  misc_feature 1..21: note = n-mer motif encoding polynucleotide
  source 1..21: mol_type = other DNA
ggcgcccgtacaatcttagac

SEQ ID NO: 5480 - DNA, 21 bp, synthetic construct
  misc_feature 1..21: note = n-mer motif encoding polynucleotide
  source 1..21: mol_type = other DNA
cacgaaagccactacgtgtca

SEQ ID NO: 5481 - DNA, 21 bp, synthetic construct
  misc_feature 1..21: note = n-mer motif encoding polynucleotide
  source 1..21: mol_type = other DNA
cttgagggtcagaataagacg

SEQ ID NO: 5482 - DNA, 21 bp, synthetic construct
  misc_feature 1..21: note = n-mer motif encoding polynucleotide
  source 1..21: mol_type = other DNA
cgggacttgagacccgtgacg

SEQ ID NO: 5483 - DNA, 21 bp, synthetic construct
  misc_feature 1..21: note = n-mer motif encoding polynucleotide
  source 1..21: mol_type = other DNA
cagattttgaattatagtgtg

SEQ ID NO: 5484 - DNA, 21 bp, synthetic construct
  misc_feature 1..21: note = n-mer motif encoding polynucleotide
  source 1..21: mol_type = other DNA
ataagtgtaggtgtgtccgta

SEQ ID NO: 5485 - DNA, 21 bp, synthetic construct
  misc_feature 1..21: note = n-mer motif encoding polynucleotide
  source 1..21: mol_type = other DNA
aaggcgggtgagtatagggat

SEQ ID NO: 5486 - DNA, 21 bp, synthetic construct
  misc_feature 1..21: note = n-mer motif encoding polynucleotide
  source 1..21: mol_type = other DNA
cttactacgaatggtatgctg

SEQ ID NO: 5487 - DNA, 21 bp, synthetic construct
  misc_feature 1..21: note = n-mer motif encoding polynucleotide
  source 1..21: mol_type = other DNA
actagtaattatatgcatgag

SEQ ID NO: 5488 - DNA, 21 bp, synthetic construct
  misc_feature 1..21: note = n-mer motif encoding polynucleotide
  source 1..21: mol_type = other DNA
acccacaactctacaggcctt

SEQ ID NO: 5489 - DNA, 21 bp, synthetic construct
  misc_feature 1..21: note = n-mer motif encoding polynucleotide
  source 1..21: mol_type = other DNA
aataatgttgttagggatgat

SEQ ID NO: 5490 - DNA, 21 bp, synthetic construct
  misc_feature 1..21: note = n-mer motif encoding polynucleotide
  source 1..21: mol_type = other DNA
agtgggacgtatgctagtcgt

SEQ ID NO: 5491 - DNA, 21 bp, synthetic construct
  misc_feature 1..21: note = n-mer motif encoding polynucleotide
  source 1..21: mol_type = other DNA
ctgtctcacgccatggaccgg

SEQ ID NO: 5492 - DNA, 21 bp, synthetic construct
  misc_feature 1..21: note = n-mer motif encoding polynucleotide
  source 1..21: mol_type = other DNA
aattggaattctgagggtacg

SEQ ID NO: 5493 - DNA, 21 bp, synthetic construct
  misc_feature 1..21: note = n-mer motif encoding polynucleotide
  source 1..21: mol_type = other DNA
agtctgcgtccaaccctacct

SEQ ID NO: 5494 - DNA, 21 bp, synthetic construct
  misc_feature 1..21: note = n-mer motif encoding polynucleotide
  source 1..21: mol_type = other DNA
taccaaacgggagacaaagac

SEQ ID NO: 5495 - DNA, 21 bp, synthetic construct
  misc_feature 1..21: note = n-mer motif encoding polynucleotide
  source 1..21: mol_type = other DNA
cgcagcgacaaaggaacgttg

SEQ ID NO: 5496 - DNA, 21 bp, synthetic construct
  misc_feature 1..21: note = n-mer motif encoding polynucleotide
  source 1..21: mol_type = other DNA
tctaccatcggcaacagcacg

SEQ ID NO: 5497 - DNA, 21 bp, synthetic construct
  misc_feature 1..21: note = n-mer motif encoding polynucleotide
  source 1..21: mol_type = other DNA
gaaaacaacatgcaacacggc

SEQ ID NO: 5498 - DNA, 21 bp, synthetic construct
  misc_feature 1..21: note = n-mer motif encoding polynucleotide
  source 1..21: mol_type = other DNA
aagtatacggagtcgaatgcg

SEQ ID NO: 5499 - DNA, 21 bp, synthetic construct
  misc_feature 1..21: note = n-mer motif encoding polynucleotide
  source 1..21: mol_type = other DNA
ccaacaaacaacttaagtatg

SEQ ID NO: 5500 - DNA, 21 bp, synthetic construct
  misc_feature 1..21: note = n-mer motif encoding polynucleotide
  source 1..21: mol_type = other DNA
tgcaaaaacaactcagaatgc

SEQ ID NO: 5501 - DNA, 21 bp, synthetic construct
  misc_feature 1..21: note = n-mer motif encoding polynucleotide
  source 1..21: mol_type = other DNA
acggttaatgcggatgggtcg

SEQ ID NO: 5502 - DNA, 21 bp, synthetic construct
  misc_feature 1..21: note = n-mer motif encoding polynucleotide
  source 1..21: mol_type = other DNA
ttttctggtcaggcgttggct

SEQ ID NO: 5503 - DNA, 21 bp, synthetic construct
  misc_feature 1..21: note = n-mer motif encoding polynucleotide
  source 1..21: mol_type = other DNA
aatcatattaggaatcctatg

SEQ ID NO: 5504 - DNA, 21 bp, synthetic construct
  misc_feature 1..21: note = n-mer motif encoding polynucleotide
  source 1..21: mol_type = other DNA
atggtgaattcggagaatact

SEQ ID NO: 5505 - DNA, 21 bp, synthetic construct
  misc_feature 1..21: note = n-mer motif encoding polynucleotide
  source 1..21: mol_type = other DNA
actgatgggccgcgtctggct

SEQ ID NO: 5506 - DNA, 21 bp, synthetic construct
  misc_feature 1..21: note = n-mer motif encoding polynucleotide
  source 1..21: mol_type = other DNA
ttcaacgggtacgtcatggca

SEQ ID NO: 5507 - DNA, 21 bp, synthetic construct
  misc_feature 1..21: note = n-mer motif encoding polynucleotide
  source 1..21: mol_type = other DNA
aatgcgaatgggcctgtgagt

SEQ ID NO: 5508 - DNA, 21 bp, synthetic construct
  misc_feature 1..21: note = n-mer motif encoding polynucleotide
  source 1..21: mol_type = other DNA
agtacgagtcaggagaatagg

SEQ ID NO: 5509 - DNA, 21 bp, synthetic construct
  misc_feature 1..21: note = n-mer motif encoding polynucleotide
  source 1..21: mol_type = other DNA
caagggactctcttgtctcca

SEQ ID NO: 5510 - DNA, 21 bp, synthetic construct
  misc_feature 1..21: note = n-mer motif encoding polynucleotide
  source 1..21: mol_type = other DNA
ctaatcacagccaccactaac

SEQ ID NO: 5511 - DNA, 21 bp, synthetic construct
  misc_feature 1..21: note = n-mer motif encoding polynucleotide
  source 1..21: mol_type = other DNA
tctggcgtctcgaaagaacgg

SEQ ID NO: 5512 - DNA, 21 bp, synthetic construct
  misc_feature 1..21: note = n-mer motif encoding polynucleotide
  source 1..21: mol_type = other DNA
tctacttcaataggagtggta

SEQ ID NO: 5513 - DNA, 21 bp, synthetic construct
  misc_feature 1..21: note = n-mer motif encoding polynucleotide
  source 1..21: mol_type = other DNA
tctcatgtgactgttacggat

SEQ ID NO: 5514 - DNA, 21 bp, synthetic construct
  misc_feature 1..21: note = n-mer motif encoding polynucleotide
  source 1..21: mol_type = other DNA
tctaataatctgaatcaggag

SEQ ID NO: 5515 - DNA, 21 bp, synthetic construct
  misc_feature 1..21: note = n-mer motif encoding polynucleotide
  source 1..21: mol_type = other DNA
gcaaaccacgacaacatcgtg

SEQ ID NO: 5516 - DNA, 21 bp, synthetic construct
  misc_feature 1..21: note = n-mer motif encoding polynucleotide
  source 1..21: mol_type = other DNA
gacacgtcctccggcaacagg

SEQ ID NO: 5517 - DNA, 21 bp, synthetic construct
  misc_feature 1..21: note = n-mer motif encoding polynucleotide
  source 1..21: mol_type = other DNA
gtggttcctatgcctactact

SEQ ID NO: 5518 - DNA, 21 bp, synthetic construct
  misc_feature 1..21: note = n-mer motif encoding polynucleotide
  source 1..21: mol_type = other DNA
cttactaataattttaaggat

SEQ ID NO: 5519 - DNA, 21 bp, synthetic construct
  misc_feature 1..21: note = n-mer motif encoding polynucleotide
  source 1..21: mol_type = other DNA
tcttcgcctactaagggtact

SEQ ID NO: 5520 - DNA, 21 bp, synthetic construct
  misc_feature 1..21: note = n-mer motif encoding polynucleotide
  source 1..21: mol_type = other DNA
gatattccgtctgataatacg

SEQ ID NO: 5521 - DNA, 21 bp, synthetic construct
  misc_feature 1..21: note = n-mer motif encoding polynucleotide
  source 1..21: mol_type = other DNA
tacacgggattcgaattgaga

SEQ ID NO: 5522 - DNA, 21 bp, synthetic construct
  misc_feature 1..21: note = n-mer motif encoding polynucleotide
  source 1..21: mol_type = other DNA
aactcaggtaacaaccccatc

SEQ ID NO: 5523 - DNA, 21 bp, synthetic construct
  misc_feature 1..21: note = n-mer motif encoding polynucleotide
  source 1..21: mol_type = other DNA
acgacccgaaacgaacactcg

SEQ ID NO: 5524 - DNA, 21 bp, synthetic construct
  misc_feature 1..21: note = n-mer motif encoding polynucleotide
  source 1..21: mol_type = other DNA
aatgtgggtaatactcttggg

SEQ ID NO: 5525 - DNA, 21 bp, synthetic construct
  misc_feature 1..21: note = n-mer motif encoding polynucleotide
  source 1..21: mol_type = other DNA
taccacacccaccaagtcgca

SEQ ID NO: 5526 - DNA, 21 bp, synthetic construct
  misc_feature 1..21: note = n-mer motif encoding polynucleotide
  source 1..21: mol_type = other DNA
ggtagtgcgagtaatagtggt

SEQ ID NO: 5527 - DNA, 21 bp, synthetic construct
  misc_feature 1..21: note = n-mer motif encoding polynucleotide
  source 1..21: mol_type = other DNA
gggaagaatcagcctactccg

SEQ ID NO: 5528 - DNA, 21 bp, synthetic construct
  misc_feature 1..21: note = n-mer motif encoding polynucleotide
  source 1..21: mol_type = other DNA
ttcaccgccactttaggaacc

SEQ ID NO: 5529 - DNA, 21 bp, synthetic construct
  misc_feature 1..21: note = n-mer motif encoding polynucleotide
  source 1..21: mol_type = other DNA
atgaaccaaatgggcggcctg

SEQ ID NO: 5530 - DNA, 21 bp, synthetic construct
  misc_feature 1..21: note = n-mer motif encoding polynucleotide
  source 1..21: mol_type = other DNA
aacgtgtcactaacgcaaacg

SEQ ID NO: 5531 - DNA, 21 bp, synthetic construct
  misc_feature 1..21: note = n-mer motif encoding polynucleotide
  source 1..21: mol_type = other DNA
tcgtctagcaacacaaacgct

SEQ ID NO: 5532 - DNA, 21 bp, synthetic construct
  misc_feature 1..21: note = n-mer motif encoding polynucleotide
  source 1..21: mol_type = other DNA
actaattctaatcagagttcg

SEQ ID NO: 5533 - DNA, 21 bp, synthetic construct
  misc_feature 1..21: note = n-mer motif encoding polynucleotide
  source 1..21: mol_type = other DNA
ataagtcacgaccttaaatac

SEQ ID NO: 5534 - DNA, 21 bp, synthetic construct
  misc_feature 1..21: note = n-mer motif encoding polynucleotide
  source 1..21: mol_type = other DNA
gattcgacgtatgttttggct

SEQ ID NO: 5535 - DNA, 21 bp, synthetic construct
  misc_feature 1..21: note = n-mer motif encoding polynucleotide
  source 1..21: mol_type = other DNA
atgaacaccggctcttcgagt

SEQ ID NO: 5536 - DNA, 21 bp, synthetic construct
  misc_feature 1..21: note = n-mer motif encoding polynucleotide
  source 1..21: mol_type = other DNA
gccggaaactaccaatcatca

SEQ ID NO: 5537 - DNA, 21 bp, synthetic construct
  misc_feature 1..21: note = n-mer motif encoding polynucleotide
  source 1..21: mol_type = other DNA
acgatttataatatgggtccg

SEQ ID NO: 5538 - DNA, 21 bp, synthetic construct
  misc_feature 1..21: note = n-mer motif encoding polynucleotide
  source 1..21: mol_type = other DNA
gtatcaacgacaacggaccgg

SEQ ID NO: 5539 - DNA, 21 bp, synthetic construct
  misc_feature 1..21: note = n-mer motif encoding polynucleotide
  source 1..21: mol_type = other DNA
ggggtgactgttagggagctt

SEQ ID NO: 5540 - DNA, 21 bp, synthetic construct
  misc_feature 1..21: note = n-mer motif encoding polynucleotide
  source 1..21: mol_type = other DNA
gatattactaatcagtcgtat

SEQ ID NO: 5541 - DNA, 21 bp, synthetic construct
  misc_feature 1..21: note = n-mer motif encoding polynucleotide
  source 1..21: mol_type = other DNA
aatcagtcgcttactatggat

SEQ ID NO: 5542 - DNA, 21 bp, synthetic construct
  misc_feature 1..21: note = n-mer motif encoding polynucleotide
  source 1..21: mol_type = other DNA
acgaattataatattggtccg

SEQ ID NO: 5543 - DNA, 21 bp, synthetic construct
  misc_feature 1..21: note = n-mer motif encoding polynucleotide
  source 1..21: mol_type = other DNA
cgtggtacggaggggacgccg

SEQ ID NO: 5544 - DNA, 21 bp, synthetic construct
  misc_feature 1..21: note = n-mer motif encoding polynucleotide
  source 1..21: mol_type = other DNA
cccataacacgggaatcggga

SEQ ID NO: 5545 - DNA, 21 bp, synthetic construct
  misc_feature 1..21: note = n-mer motif encoding polynucleotide
  source 1..21: mol_type = other DNA
accggacaagcgggcggatcg

SEQ ID NO: 5546 - DNA, 21 bp, synthetic construct
  misc_feature 1..21: note = n-mer motif encoding polynucleotide
  source 1..21: mol_type = other DNA
atgactaaacacgacgcgacg

SEQ ID NO: 5547 - DNA, 21 bp, synthetic construct
  misc_feature 1..21: note = n-mer motif encoding polynucleotide
  source 1..21: mol_type = other DNA
cctataccccacggttcatcc

SEQ ID NO: 5548 - DNA, 21 bp, synthetic construct
  misc_feature 1..21: note = n-mer motif encoding polynucleotide
  source 1..21: mol_type = other DNA
acgactggggggacggggatg

SEQ ID NO: 5549 - DNA, 21 bp, synthetic construct
  misc_feature 1..21: note = n-mer motif encoding polynucleotide
  source 1..21: mol_type = other DNA
ctaaccgaatctgtgagaaac

SEQ ID NO: 5550 - DNA, 21 bp, synthetic construct
  misc_feature 1..21: note = n-mer motif encoding polynucleotide
  source 1..21: mol_type = other DNA
agtagtaatctgactttgtct

SEQ ID NO: 5551 - DNA, 21 bp, synthetic construct
  misc_feature 1..21: note = n-mer motif encoding polynucleotide
  source 1..21: mol_type = other DNA
ttgaataattctgcgactgtt

SEQ ID NO: 5552 - DNA, 21 bp, synthetic construct
  misc_feature 1..21: note = n-mer motif encoding polynucleotide
  source 1..21: mol_type = other DNA
gcatacggatcgtccggaaga

SEQ ID NO: 5553 - DNA, 21 bp, synthetic construct
  misc_feature 1..21: note = n-mer motif encoding polynucleotide
  source 1..21: mol_type = other DNA
gtttcttatgataatgggtcg

SEQ ID NO: 5554 - DNA, 21 bp, synthetic construct
  misc_feature 1..21: note = n-mer motif encoding polynucleotide
  source 1..21: mol_type = other DNA
ccgagtcagagtaggtcgctt

SEQ ID NO: 5555 - DNA, 21 bp, synthetic construct
  misc_feature 1..21: note = n-mer motif encoding polynucleotide
  source 1..21: mol_type = other DNA
gtcctggttaacgtacacaac

SEQ ID NO: 5556 - DNA, 21 bp, synthetic construct
  misc_feature 1..21: note = n-mer motif encoding polynucleotide
  source 1..21: mol_type = other DNA
ttgatgactggtactgcgtcg

SEQ ID NO: 5557 - DNA, 21 bp, synthetic construct
  misc_feature 1..21: note = n-mer motif encoding polynucleotide
  source 1..21: mol_type = other DNA
gctgctggtaatcctactcgt

SEQ ID NO: 5558 - DNA, 21 bp, synthetic construct
  misc_feature 1..21: note = n-mer motif encoding polynucleotide
  source 1..21: mol_type = other DNA
tccgcgcaatctttcgtagtt

SEQ ID NO: 5559 - DNA, 21 bp, synthetic construct
  misc_feature 1..21: note = n-mer motif encoding polynucleotide
  source 1..21: mol_type = other DNA
caagaccaaacgagcaaccgt

SEQ ID NO: 5560 - DNA, 21 bp, synthetic construct
  misc_feature 1..21: note = n-mer motif encoding polynucleotide
  source 1..21: mol_type = other DNA
cagtcgattgggcatccggtg

SEQ ID NO: 5561 - DNA, 21 bp, synthetic construct
  misc_feature 1..21: note = n-mer motif encoding polynucleotide
  source 1..21: mol_type = other DNA
gctggggtgcgtgagtcgttt

SEQ ID NO: 5562 - DNA, 21 bp, synthetic construct
  misc_feature 1..21: note = n-mer motif encoding polynucleotide
  source 1..21: mol_type = other DNA
aatactaattatgcgatgcat

SEQ ID NO: 5563 - DNA, 21 bp, synthetic construct
  misc_feature 1..21: note = n-mer motif encoding polynucleotide
  source 1..21: mol_type = other DNA
gagcggagtacgcataatgtt

SEQ ID NO: 5564 - DNA, 21 bp, synthetic construct
  misc_feature 1..21: note = n-mer motif encoding polynucleotide
  source 1..21: mol_type = other DNA
atgtccggatccatgatatca

SEQ ID NO: 5565 - DNA, 21 bp, synthetic construct
  misc_feature 1..21: note = n-mer motif encoding polynucleotide
  source 1..21: mol_type = other DNA
tctggccaaggattctcggca

SEQ ID NO: 5566 - DNA, 21 bp, synthetic construct
  misc_feature 1..21: note = n-mer motif encoding polynucleotide
  source 1..21: mol_type = other DNA
acattcactactctgggcaaa

SEQ ID NO: 5567 - DNA, 21 bp, synthetic construct
  misc_feature 1..21: note = n-mer motif encoding polynucleotide
  source 1..21: mol_type = other DNA
gacgcaaacgctggcacaaga

SEQ ID NO: 5568 - DNA, 21 bp, synthetic construct
  misc_feature 1..21: note = n-mer motif encoding polynucleotide
  source 1..21: mol_type = other DNA
agggatacggctaagggggtg

SEQ ID NO: 5569 - DNA, 21 bp, synthetic construct
  misc_feature 1..21: note = n-mer motif encoding polynucleotide
  source 1..21: mol_type = other DNA
gtgcggtctggtaataagccg

SEQ ID NO: 5570 - DNA, 21 bp, synthetic construct
  misc_feature 1..21: note = n-mer motif encoding polynucleotide
  source 1..21: mol_type = other DNA
ccccaatggggaactgacccg

SEQ ID NO: 5571 - DNA, 21 bp, synthetic construct
  misc_feature 1..21: note = n-mer motif encoding polynucleotide
  source 1..21: mol_type = other DNA
gccttccaaaacaccggcgca

SEQ ID NO: 5572 - DNA, 21 bp, synthetic construct
  misc_feature 1..21: note = n-mer motif encoding polynucleotide
  source 1..21: mol_type = other DNA
gcgacgactcagctgatgact

SEQ ID NO: 5573 - DNA, 21 bp, synthetic construct
  misc_feature 1..21: note = n-mer motif encoding polynucleotide
  source 1..21: mol_type = other DNA
acgaacgcgagcgaaggctca

SEQ ID NO: 5574 - DNA, 21 bp, synthetic construct
  misc_feature 1..21: note = n-mer motif encoding polynucleotide
  source 1..21: mol_type = other DNA
atgctcacagaaaccaaagca

SEQ ID NO: 5575 - DNA, 21 bp, synthetic construct
  misc_feature 1..21: note = n-mer motif encoding polynucleotide
  source 1..21: mol_type = other DNA
acgaataatttgctggctcag

SEQ ID NO: 5576 - DNA, 21 bp, synthetic construct
  misc_feature 1..21: note = n-mer motif encoding polynucleotide
  source 1..21: mol_type = other DNA
gatgttttgcttaagaatttt

SEQ ID NO: 5577 - DNA, 21 bp, synthetic construct
  misc_feature 1..21: note = n-mer motif encoding polynucleotide
  source 1..21: mol_type = other DNA
tatacgcctgggcttactgag

SEQ ID NO: 5578 - DNA, 21 bp, synthetic construct
  misc_feature 1..21: note = n-mer motif encoding polynucleotide
  source 1..21: mol_type = other DNA
cggcatgcttcggatgctaat

SEQ ID NO: 5579 - DNA, 21 bp, synthetic construct
  misc_feature 1..21: note = n-mer motif encoding polynucleotide
  source 1..21: mol_type = other DNA
agtaagggtgatcagcttaat

SEQ ID NO: 5580 - DNA, 21 bp, synthetic construct
  misc_feature 1..21: note = n-mer motif encoding polynucleotide
  source 1..21: mol_type = other DNA
gtgctggttactcagaatcat

SEQ ID NO: 5581 - DNA, 21 bp, synthetic construct
  misc_feature 1..21: note = n-mer motif encoding polynucleotide
  source 1..21: mol_type = other DNA
cgacaaggcgacttaaaagaa

SEQ ID NO: 5582 - DNA, 21 bp, synthetic construct
  misc_feature 1..21: note = n-mer motif encoding polynucleotide
  source 1..21: mol_type = other DNA
attcagtcgcagtcgcagttg

SEQ ID NO: 5583 - DNA, 21 bp, synthetic construct
  misc_feature 1..21: note = n-mer motif encoding polynucleotide
  source 1..21: mol_type = other DNA
aaaatagaaagcggaaccata

SEQ ID NO: 5584 - DNA, 21 bp, synthetic construct
  misc_feature 1..21: note = n-mer motif encoding polynucleotide
  source 1..21: mol_type = other DNA
acaactcttagccaacaaagc

SEQ ID NO: 5585 - DNA, 21 bp, synthetic construct
  misc_feature 1..21: note = n-mer motif encoding polynucleotide
  source 1..21: mol_type = other DNA
tttcagttggctagtaatccg

SEQ ID NO: 5586 - DNA, 21 bp, synthetic construct
  misc_feature 1..21: note = n-mer motif encoding polynucleotide
  source 1..21: mol_type = other DNA
tggatttctactgagatgagg

SEQ ID NO: 5587 - DNA, 21 bp, synthetic construct
  misc_feature 1..21: note = n-mer motif encoding polynucleotide
  source 1..21: mol_type = other DNA
gccataacaatcactcaaaaa

SEQ ID NO: 5588 - DNA, 21 bp, synthetic construct
  misc_feature 1..21: note = n-mer motif encoding polynucleotide
  source 1..21: mol_type = other DNA
gttactggtgttgattatgcg

SEQ ID NO: 5589 - DNA, 21 bp, synthetic construct
  misc_feature 1..21: note = n-mer motif encoding polynucleotide
  source 1..21: mol_type = other DNA
ataatagcatcctctaccacg

SEQ ID NO: 5590 - DNA, 21 bp, synthetic construct
  misc_feature 1..21: note = n-mer motif encoding polynucleotide
  source 1..21: mol_type = other DNA
atttatacgaatagtcatgtt

SEQ ID NO: 5591 - DNA, 21 bp, synthetic construct
  misc_feature 1..21: note = n-mer motif encoding polynucleotide
  source 1..21: mol_type = other DNA
aacgacatccccacacgagcc

SEQ ID NO: 5592 - DNA, 21 bp, synthetic construct
  misc_feature 1..21: note = n-mer motif encoding polynucleotide
  source 1..21: mol_type = other DNA
ggcgtaaccaacgcttccaaa

SEQ ID NO: 5593 - DNA, 21 bp, synthetic construct
  misc_feature 1..21: note = n-mer motif encoding polynucleotide
  source 1..21: mol_type = other DNA
aggggtaacactctcgaaatg

SEQ ID NO: 5594 - DNA, 21 bp, synthetic construct
  misc_feature 1..21: note = n-mer motif encoding polynucleotide
  source 1..21: mol_type = other DNA
ggtattaatcatgtggcgtct

SEQ ID NO: 5595 - DNA, 21 bp, synthetic construct
  misc_feature 1..21: note = n-mer motif encoding polynucleotide
  source 1..21: mol_type = other DNA
ttcaacgaaactgccgggcga

SEQ ID NO: 5596 - DNA, 21 bp, synthetic construct
  misc_feature 1..21: note = n-mer motif encoding polynucleotide
  source 1..21: mol_type = other DNA
gcctcgcaatcagaaaaaaac

SEQ ID NO: 5597 - DNA, 21 bp, synthetic construct
  misc_feature 1..21: note = n-mer motif encoding polynucleotide
  source 1..21: mol_type = other DNA
gaacttaacgaaaggaacctc

SEQ ID NO: 5598 - DNA, 21 bp, synthetic construct
  misc_feature 1..21: note = n-mer motif encoding polynucleotide
  source 1..21: mol_type = other DNA
ggagaacaaagccacaaccaa

SEQ ID NO: 5599 - DNA, 21 bp, synthetic construct
  misc_feature 1..21: note = n-mer motif encoding polynucleotide
  source 1..21: mol_type = other DNA
ttgactaatgataataagttg

SEQ ID NO: 5600 - DNA, 21 bp, synthetic construct
  misc_feature 1..21: note = n-mer motif encoding polynucleotide
  source 1..21: mol_type = other DNA
tcttatgggcagggtctggag

SEQ ID NO: 5601 - DNA, 21 bp, synthetic construct
  misc_feature 1..21: note = n-mer motif encoding polynucleotide
  source 1..21: mol_type = other DNA
cacagtgacatgggctcaagc

SEQ ID NO: 5602 - DNA, 21 bp, synthetic construct
  misc_feature 1..21: note = n-mer motif encoding polynucleotide
  source 1..21: mol_type = other DNA
gcgttaaaatccgacagcgcc

SEQ ID NO: 5603 - DNA, 21 bp, synthetic construct
  misc_feature 1..21: note = n-mer motif encoding polynucleotide
  source 1..21: mol_type = other DNA
acgaatctttctcctaagacg

SEQ ID NO: 5604 - DNA, 21 bp, synthetic construct
  misc_feature 1..21: note = n-mer motif encoding polynucleotide
  source 1..21: mol_type = other DNA
gctgatacgaatattattgtg

SEQ ID NO: 5605 - DNA, 21 bp, synthetic construct
  misc_feature 1..21: note = n-mer motif encoding polynucleotide
  source 1..21: mol_type = other DNA
agtgagggtagttcgcggtcg

SEQ ID NO: 5606 - DNA, 21 bp, synthetic construct
  misc_feature 1..21: note = n-mer motif encoding polynucleotide
  source 1..21: mol_type = other DNA
aactctagtaacactggttgg

SEQ ID NO: 5607 - DNA, 21 bp, synthetic construct
  misc_feature 1..21: note = n-mer motif encoding polynucleotide
  source 1..21: mol_type = other DNA
gtaacgaacgaatcccgcgcc

SEQ ID NO: 5608 - DNA, 21 bp, synthetic construct
  misc_feature 1..21: note = n-mer motif encoding polynucleotide
  source 1..21: mol_type = other DNA
gggcggcacacattagcggac

SEQ ID NO: 5609 - DNA, 21 bp, synthetic construct
  misc_feature 1..21: note = n-mer motif encoding polynucleotide
  source 1..21: mol_type = other DNA
gctgttgtgaatgttgcgcag

SEQ ID NO: 5610 - DNA, 21 bp, synthetic construct
  misc_feature 1..21: note = n-mer motif encoding polynucleotide
  source 1..21: mol_type = other DNA
aaaaaaccacaacagtgacta

SEQ ID NO: 5611 - DNA, 21 bp, synthetic construct
  misc_feature 1..21: note = n-mer motif encoding polynucleotide
  source 1..21: mol_type = other DNA
ggcaacgcttccggaaaccca

SEQ ID NO: 5612 - DNA, 21 bp, synthetic construct
  misc_feature 1..21: note = n-mer motif encoding polynucleotide
  source 1..21: mol_type = other DNA
tttgcggctggggcgcatggt

SEQ ID NO: 5613 - DNA, 21 bp, synthetic construct
  misc_feature 1..21: note = n-mer motif encoding polynucleotide
  source 1..21: mol_type = other DNA
ggaggaaaccaaaaccttact

SEQ ID NO: 5614 - DNA, 21 bp, synthetic construct
  misc_feature 1..21: note = n-mer motif encoding polynucleotide
  source 1..21: mol_type = other DNA
catacgcagtcgacgggttat

SEQ ID NO: 5615 - DNA, 21 bp, synthetic construct
  misc_feature 1..21: note = n-mer motif encoding polynucleotide
  source 1..21: mol_type = other DNA
ctattgggaaacgcacccaca

SEQ ID NO: 5616 - DNA, 21 bp, synthetic construct
  misc_feature 1..21: note = n-mer motif encoding polynucleotide
  source 1..21: mol_type = other DNA
gagaaggggaatagtggggtt

SEQ ID NO: 5617 - DNA, 21 bp, synthetic construct
  misc_feature 1..21: note = n-mer motif encoding polynucleotide
  source 1..21: mol_type = other DNA
ggcacggaaccgcgcactgca

SEQ ID NO: 5618 - DNA, 21 bp, synthetic construct
  misc_feature 1..21: note = n-mer motif encoding polynucleotide
  source 1..21: mol_type = other DNA
atgcatgcgcaggagtctcgt

SEQ ID NO: 5619 - DNA, 21 bp, synthetic construct
  misc_feature 1..21: note = n-mer motif encoding polynucleotide
  source 1..21: mol_type = other DNA
ctgatttcgactggtaataat

SEQ ID NO: 5620 - DNA, 21 bp, synthetic construct
  misc_feature 1..21: note = n-mer motif encoding polynucleotide
  source 1..21: mol_type = other DNA
aagaataataattctgattct

SEQ ID NO: 5621 - DNA, 21 bp, synthetic construct
  misc_feature 1..21: note = n-mer motif encoding polynucleotide
  source 1..21: mol_type = other DNA
gggacattagcctcaatgtcc

SEQ ID NO: 5622 - DNA, 21 bp, synthetic construct
  misc_feature 1..21: note = n-mer motif encoding polynucleotide
  source 1..21: mol_type = other DNA
aggattgatacgttgttggtg

SEQ ID NO: 5623 - DNA, 21 bp, synthetic construct
  misc_feature 1..21: note = n-mer motif encoding polynucleotide
  source 1..21: mol_type = other DNA
atttcggggtctcatttgaat

SEQ ID NO: 5624 - DNA, 21 bp, synthetic construct
  misc_feature 1..21: note = n-mer motif encoding polynucleotide
  source 1..21: mol_type = other DNA
acggttgagggttcttatccg

SEQ ID NO: 5625 - DNA, 21 bp, synthetic construct
  misc_feature 1..21: note = n-mer motif encoding polynucleotide
  source 1..21: mol_type = other DNA
acggagtatctggctggtctg

SEQ ID NO: 5626 - DNA, 21 bp, synthetic construct
  misc_feature 1..21: note = n-mer motif encoding polynucleotide
  source 1..21: mol_type = other DNA
tatctggagggtgctcatcgt

SEQ ID NO: 5627 - DNA, 21 bp, synthetic construct
  misc_feature 1..21: note = n-mer motif encoding polynucleotide
  source 1..21: mol_type = other DNA
ttatccgcaacatctacgatg

SEQ ID NO: 5628 - DNA, 21 bp, synthetic construct
  misc_feature 1..21: note = n-mer motif encoding polynucleotide
  source 1..21: mol_type = other DNA
atgcttagtcaggttctgacg

SEQ ID NO: 5629 - DNA, 21 bp, synthetic construct
  misc_feature 1..21: note = n-mer motif encoding polynucleotide
  source 1..21: mol_type = other DNA
gccaggaacgtaatgctgggg

SEQ ID NO: 5630 - DNA, 21 bp, synthetic construct
  misc_feature 1..21: note = n-mer motif encoding polynucleotide
  source 1..21: mol_type = other DNA
cttcatgggaattttagtcag

SEQ ID NO: 5631 - DNA, 21 bp, synthetic construct
  misc_feature 1..21: note = n-mer motif encoding polynucleotide
  source 1..21: mol_type = other DNA
ggccacggaagtgacttgacc

SEQ ID NO: 5632 - DNA, 21 bp, synthetic construct
  misc_feature 1..21: note = n-mer motif encoding polynucleotide
  source 1..21: mol_type = other DNA
ggtgtgaattatcatactacg

SEQ ID NO: 5633 - DNA, 21 bp, synthetic construct
  misc_feature 1..21: note = n-mer motif encoding polynucleotide
  source 1..21: mol_type = other DNA
tatctgcagacgggtactctg

SEQ ID NO: 5634 - DNA, 21 bp, synthetic construct
  misc_feature 1..21: note = n-mer motif encoding polynucleotide
  source 1..21: mol_type = other DNA
gtaaacgggggaaaaccagtc

SEQ ID NO: 5635 - DNA, 21 bp, synthetic construct
  misc_feature 1..21: note = n-mer motif encoding polynucleotide
  source 1..21: mol_type = other DNA
gaagtaggtaaaaccacccac

SEQ ID NO: 5636 - DNA, 21 bp, synthetic construct
  misc_feature 1..21: note = n-mer motif encoding polynucleotide
  source 1..21: mol_type = other DNA
cgacccccgaacgaaaacaga

SEQ ID NO: 5637 - DNA, 21 bp, synthetic construct
  misc_feature 1..21: note = n-mer motif encoding polynucleotide
  source 1..21: mol_type = other DNA
gtggataagaatcatcctttg

SEQ ID NO: 5638 - DNA, 21 bp, synthetic construct
  misc_feature 1..21: note = n-mer motif encoding polynucleotide
  source 1..21: mol_type = other DNA
agtaagtcgactgagattatg

SEQ ID NO: 5639 - DNA, 21 bp, synthetic construct
  misc_feature 1..21: note = n-mer motif encoding polynucleotide
  source 1..21: mol_type = other DNA
accgctcttctatctaactta

SEQ ID NO: 5640 - DNA, 21 bp, synthetic construct
  misc_feature 1..21: note = n-mer motif encoding polynucleotide
  source 1..21: mol_type = other DNA
atgcacacaagtagaccccca

SEQ ID NO: 5641 - DNA, 21 bp, synthetic construct
  misc_feature 1..21: note = n-mer motif encoding polynucleotide
  source 1..21: mol_type = other DNA
actccaactaacgggaaccct

SEQ ID NO: 5642 - DNA, 21 bp, synthetic construct
  misc_feature 1..21: note = n-mer motif encoding polynucleotide
  source 1..21: mol_type = other DNA
acgacgtctgtggagaagact

SEQ ID NO: 5643 - DNA, 21 bp, synthetic construct
  misc_feature 1..21: note = n-mer motif encoding polynucleotide
  source 1..21: mol_type = other DNA
caatacgacgccagccgacaa

SEQ ID NO: 5644 - DNA, 21 bp, synthetic construct
  misc_feature 1..21: note = n-mer motif encoding polynucleotide
  source 1..21: mol_type = other DNA
tacaacgcccacgaatcattc

SEQ ID NO: 5645 - DNA, 21 bp, synthetic construct
  misc_feature 1..21: note = n-mer motif encoding polynucleotide
  source 1..21: mol_type = other DNA
gacaaccaacaagccctagct

SEQ ID NO: 5646 - DNA, 21 bp, synthetic construct
  misc_feature 1..21: note = n-mer motif encoding polynucleotide
  source 1..21: mol_type = other DNA
acgaagagttttaatgatctt

SEQ ID NO: 5647 - DNA, 21 bp, synthetic construct
  misc_feature 1..21: note = n-mer motif encoding polynucleotide
  source 1..21: mol_type = other DNA
ttagccgactcaaacagcaaa

SEQ ID NO: 5648 - DNA, 21 bp, synthetic construct
  misc_feature 1..21: note = n-mer motif encoding polynucleotide
  source 1..21: mol_type = other DNA
ccgagtactcatgggtatgtt

SEQ ID NO: 5649 - DNA, 21 bp, synthetic construct
  misc_feature 1..21: note = n-mer motif encoding polynucleotide
  source 1..21: mol_type = other DNA
caggttcaggggactctgggg

SEQ ID NO: 5650 - DNA, 21 bp, synthetic construct
  misc_feature 1..21: note = n-mer motif encoding polynucleotide
  source 1..21: mol_type = other DNA
ctgactgctgttgcgattagt

SEQ ID NO: 5651 - DNA, 21 bp, synthetic construct
  misc_feature 1..21: note = n-mer motif encoding polynucleotide
  source 1..21: mol_type = other DNA
aggtatgagagtactagtgct

SEQ ID NO: 5652 - DNA, 21 bp, synthetic construct
  misc_feature 1..21: note = n-mer motif encoding polynucleotide
  source 1..21: mol_type = other DNA
gcggatcataatcatattgct

SEQ ID NO: 5653 - DNA, 21 bp, synthetic construct
  misc_feature 1..21: note = n-mer motif encoding polynucleotide
  source 1..21: mol_type = other DNA
tggaatgctgagaatagtaag

SEQ ID NO: 5654 - DNA, 21 bp, synthetic construct
  misc_feature 1..21: note = n-mer motif encoding polynucleotide
  source 1..21: mol_type = other DNA
aactctgtcgtagggaacatc

SEQ ID NO: 5655 - DNA, 21 bp, synthetic construct
  misc_feature 1..21: note = n-mer motif encoding polynucleotide
  source 1..21: mol_type = other DNA
ttcggagcaaccaccacagca

SEQ ID NO: 5656 - DNA, 21 bp, synthetic construct
  misc_feature 1..21: note = n-mer motif encoding polynucleotide
  source 1..21: mol_type = other DNA
gcttcagggtctgaaatgcct

SEQ ID NO: 5657 - DNA, 21 bp, synthetic construct
  misc_feature 1..21: note = n-mer motif encoding polynucleotide
  source 1..21: mol_type = other DNA
gacggaacaaaaagcggaatg

SEQ ID NO: 5658 - DNA, 21 bp, synthetic construct
  misc_feature 1..21: note = n-mer motif encoding polynucleotide
  source 1..21: mol_type = other DNA
tacaccgccgacaaaaaacaa

SEQ ID NO: 5659 - DNA, 21 bp, synthetic construct
  misc_feature 1..21: note = n-mer motif encoding polynucleotide
  source 1..21: mol_type = other DNA
ccgattgctgagaggccttct

SEQ ID NO: 5660 - DNA, 21 bp, synthetic construct
  misc_feature 1..21: note = n-mer motif encoding polynucleotide
  source 1..21: mol_type = other DNA
agcaactcgtacttactcaac

SEQ ID NO: 5661 - DNA, 21 bp, synthetic construct
  misc_feature 1..21: note = n-mer motif encoding polynucleotide
  source 1..21: mol_type = other DNA
acgagagaattgacaaaaaac

SEQ ID NO: 5662 - DNA, 21 bp, synthetic construct
  misc_feature 1..21: note = n-mer motif encoding polynucleotide
  source 1..21: mol_type = other DNA
ctcggaaaccactacacaccc

SEQ ID NO: 5663 - DNA, 21 bp, synthetic construct
  misc_feature 1..21: note = n-mer motif encoding polynucleotide
  source 1..21: mol_type = other DNA
ttgctccaatccatagtggta

SEQ ID NO: 5664 - DNA, 21 bp, synthetic construct
  misc_feature 1..21: note = n-mer motif encoding polynucleotide
  source 1..21: mol_type = other DNA
atgatggcgaataatatgcag

SEQ ID NO: 5665 - DNA, 21 bp, synthetic construct
  misc_feature 1..21: note = n-mer motif encoding polynucleotide
  source 1..21: mol_type = other DNA
ggcgcggacacctcgacccgg

SEQ ID NO: 5666 - DNA, 21 bp, synthetic construct
  misc_feature 1..21: note = n-mer motif encoding polynucleotide
  source 1..21: mol_type = other DNA
gggttcgggcacgtgcccgaa

SEQ ID NO: 5667 - DNA, 21 bp, synthetic construct
  misc_feature 1..21: note = n-mer motif encoding polynucleotide
  source 1..21: mol_type = other DNA
aacgttatgcactcttcctcc

SEQ ID NO: 5668 - DNA, 21 bp, synthetic construct
  misc_feature 1..21: note = n-mer motif encoding polynucleotide
  source 1..21: mol_type = other DNA
tctgcgtcgaaagtggaatac

SEQ ID NO: 5669 - DNA, 21 bp, synthetic construct
  misc_feature 1..21: note = n-mer motif encoding polynucleotide
  source 1..21: mol_type = other DNA
atttcgagttatgatggtaat

SEQ ID NO: 5670 - DNA, 21 bp, synthetic construct
  misc_feature 1..21: note = n-mer motif encoding polynucleotide
  source 1..21: mol_type = other DNA
aaaaaaacgaaaacactaact

SEQ ID NO: 5671 - DNA, 21 bp, synthetic construct
  misc_feature 1..21: note = n-mer motif encoding polynucleotide
  source 1..21: mol_type = other DNA
ggtaccatattaccaaaccaa

SEQ ID NO: 5672 - DNA, 21 bp, synthetic construct
  misc_feature 1..21: note = n-mer motif encoding polynucleotide
  source 1..21: mol_type = other DNA
ttaaacgtcgtaccaacacaa

SEQ ID NO: 5673 - DNA, 21 bp, synthetic construct
  misc_feature 1..21: note = n-mer motif encoding polynucleotide
  source 1..21: mol_type = other DNA
agtagtgttacttcgagggag

SEQ ID NO: 5674 - DNA, 21 bp, synthetic construct
  misc_feature 1..21: note = n-mer motif encoding polynucleotide
  source 1..21: mol_type = other DNA
cccatcaacgtactcacgaca

SEQ ID NO: 5675 - DNA, 21 bp, synthetic construct
  misc_feature 1..21: note = n-mer motif encoding polynucleotide
  source 1..21: mol_type = other DNA
ggggataaggcgagtttggcg

SEQ ID NO: 5676 - DNA, 21 bp, synthetic construct
  misc_feature 1..21: note = n-mer motif encoding polynucleotide
  source 1..21: mol_type = other DNA
aggatgtcggagagttctgat

SEQ ID NO: 5677 - DNA, 21 bp, synthetic construct
  misc_feature 1..21: note = n-mer motif encoding polynucleotide
  source 1..21: mol_type = other DNA
aatcttttgacttcgtcgcct

SEQ ID NO: 5678 - DNA, 21 bp, synthetic construct
  misc_feature 1..21: note = n-mer motif encoding polynucleotide
  source 1..21: mol_type = other DNA
tcgcggctatcacaagacccc

SEQ ID NO: 5679 - DNA, 21 bp, synthetic construct
  misc_feature 1..21: note = n-mer motif encoding polynucleotide
  source 1..21: mol_type = other DNA
tggtcgaatgctcagagtccg

SEQ ID NO: 5680 - DNA, 21 bp, synthetic construct
  misc_feature 1..21: note = n-mer motif encoding polynucleotide
  source 1..21: mol_type = other DNA
ggcagacaccttcaatcggac

SEQ ID NO: 5681 - DNA, 21 bp, synthetic construct
  misc_feature 1..21: note = n-mer motif encoding polynucleotide
  source 1..21: mol_type = other DNA
atgagtctcgcctccacccaa

SEQ ID NO: 5682 - DNA, 21 bp, synthetic construct
  misc_feature 1..21: note = n-mer motif encoding polynucleotide
  source 1..21: mol_type = other DNA
atgagtacggttcttcgcgag

SEQ ID NO: 5683 - DNA, 21 bp, synthetic construct
  misc_feature 1..21: note = n-mer motif encoding polynucleotide
  source 1..21: mol_type = other DNA
tctaaatctgaaaacctgcaa

SEQ ID NO: 5684 - DNA, 21 bp, synthetic construct
  misc_feature 1..21: note = n-mer motif encoding polynucleotide
  source 1..21: mol_type = other DNA
tggacggaagggggctcagga

SEQ ID NO: 5685 - DNA, 21 bp, synthetic construct
  misc_feature 1..21: note = n-mer motif encoding polynucleotide
  source 1..21: mol_type = other DNA
tcgactacggtttggactgct

SEQ ID NO: 5686 - DNA, 21 bp, synthetic construct
  misc_feature 1..21: note = n-mer motif encoding polynucleotide
  source 1..21: mol_type = other DNA
gttagtttggagagtcggttg

SEQ ID NO: 5687 - DNA, 21 bp, synthetic construct
  misc_feature 1..21: note = n-mer motif encoding polynucleotide
  source 1..21: mol_type = other DNA
tctatgtatgggcaggctggg

SEQ ID NO: 5688 - DNA, 21 bp, synthetic construct
  misc_feature 1..21: note = n-mer motif encoding polynucleotide
  source 1..21: mol_type = other DNA
actaatacgcagaataatccg

SEQ ID NO: 5689 - DNA, 21 bp, synthetic construct
  misc_feature 1..21: note = n-mer motif encoding polynucleotide
  source 1..21: mol_type = other DNA
gtcggtgacaggaacttggtc

SEQ ID NO: 5690 - DNA, 21 bp, synthetic construct
  misc_feature 1..21: note = n-mer motif encoding polynucleotide
  source 1..21: mol_type = other DNA
ctcgcccacaactacttaagc

SEQ ID NO: 5691 - DNA, 21 bp, synthetic construct
  misc_feature 1..21: note = n-mer motif encoding polynucleotide
  source 1..21: mol_type = other DNA
tggacagctaaccaaggctta

SEQ ID NO: 5692 - DNA, 21 bp, synthetic construct
  misc_feature 1..21: note = n-mer motif encoding polynucleotide
  source 1..21: mol_type = other DNA
gtcttccgggaaggcatcgtg

SEQ ID NO: 5693 - DNA, 21 bp, synthetic construct
  misc_feature 1..21: note = n-mer motif encoding polynucleotide
  source 1..21: mol_type = other DNA
caggtgcagcatgagagggtg

SEQ ID NO: 5694 - DNA, 21 bp, synthetic construct
  misc_feature 1..21: note = n-mer motif encoding polynucleotide
  source 1..21: mol_type = other DNA
caaatattaaactactcagtc

SEQ ID NO: 5695 - DNA, 21 bp, synthetic construct
  misc_feature 1..21: note = n-mer motif encoding polynucleotide
  source 1..21: mol_type = other DNA
agtacgattggtaattctact

SEQ ID NO: 5696 - DNA, 21 bp, synthetic construct
  misc_feature 1..21: note = n-mer motif encoding polynucleotide
  source 1..21: mol_type = other DNA
cctatacaccacggttcatcc

SEQ ID NO: 5697 - DNA, 21 bp, synthetic construct
  misc_feature 1..21: note = n-mer motif encoding polynucleotide
  source 1..21: mol_type = other DNA
attgctactaatgtgatttat

SEQ ID NO: 5698 - DNA, 21 bp, synthetic construct
  misc_feature 1..21: note = n-mer motif encoding polynucleotide
  source 1..21: mol_type = other DNA
caaggcggtacaaacaacccc

SEQ ID NO: 5699 - DNA, 21 bp, synthetic construct
  misc_feature 1..21: note = n-mer motif encoding polynucleotide
  source 1..21: mol_type = other DNA
acccgtggcaacgacatatca

SEQ ID NO: 5700 - DNA, 21 bp, synthetic construct
  misc_feature 1..21: note = n-mer motif encoding polynucleotide
  source 1..21: mol_type = other DNA
caaacgctcatagtggggtcc

SEQ ID NO: 5701 - DNA, 21 bp, synthetic construct
  misc_feature 1..21: note = n-mer motif encoding polynucleotide
  source 1..21: mol_type = other DNA
cggggtctgcctgatgttaat

SEQ ID NO: 5702 - DNA, 21 bp, synthetic construct
  misc_feature 1..21: note = n-mer motif encoding polynucleotide
  source 1..21: mol_type = other DNA
cttaatgtgaatacgcttaat

SEQ ID NO: 5703 - DNA, 21 bp, synthetic construct
  misc_feature 1..21: note = n-mer motif encoding polynucleotide
  source 1..21: mol_type = other DNA
gggacaaaaagctggcctgtc

SEQ ID NO: 5704 - DNA, 21 bp, synthetic construct
  misc_feature 1..21: note = n-mer motif encoding polynucleotide
  source 1..21: mol_type = other DNA
acgcatcttgtgagtgattcg

SEQ ID NO: 5705 - DNA, 21 bp, synthetic construct
  misc_feature 1..21: note = n-mer motif encoding polynucleotide
  source 1..21: mol_type = other DNA
tggacgggcgcacaaccttct

SEQ ID NO: 5706 - DNA, 21 bp, synthetic construct
  misc_feature 1..21: note = n-mer motif encoding polynucleotide
  source 1..21: mol_type = other DNA
tctgcgatgcacacattagtc

SEQ ID NO: 5707 - DNA, 21 bp, synthetic construct
  misc_feature 1..21: note = n-mer motif encoding polynucleotide
  source 1..21: mol_type = other DNA
tcccaacaccacacgccactg

SEQ ID NO: 5708 - DNA, 21 bp, synthetic construct
  misc_feature 1..21: note = n-mer motif encoding polynucleotide
  source 1..21: mol_type = other DNA
gataatcggatggaggctacg

SEQ ID NO: 5709 - DNA, 21 bp, synthetic construct
  misc_feature 1..21: note = n-mer motif encoding polynucleotide
  source 1..21: mol_type = other DNA
ttgggaggaaccctgggaata

SEQ ID NO: 5710 - DNA, 21 bp, synthetic construct
  misc_feature 1..21: note = n-mer motif encoding polynucleotide
  source 1..21: mol_type = other DNA
tttcataatgagtcttatggg

SEQ ID NO: 5711 - DNA, 21 bp, synthetic construct
  misc_feature 1..21: note = n-mer motif encoding polynucleotide
  source 1..21: mol_type = other DNA
attcggacttctgtgattaat

SEQ ID NO: 5712 - DNA, 21 bp, synthetic construct
  misc_feature 1..21: note = n-mer motif encoding polynucleotide
  source 1..21: mol_type = other DNA
tataatactgttgatcagcgg

SEQ ID NO: 5713 - DNA, 21 bp, synthetic construct
  misc_feature 1..21: note = n-mer motif encoding polynucleotide
  source 1..21: mol_type = other DNA
gcgcaccaaaccgccgggcca

SEQ ID NO: 5714 - DNA, 21 bp, synthetic construct
  misc_feature 1..21: note = n-mer motif encoding polynucleotide
  source 1..21: mol_type = other DNA
cctccggaaagtgccaggggc

SEQ ID NO: 5715 - DNA, 21 bp, synthetic construct
  misc_feature 1..21: note = n-mer motif encoding polynucleotide
  source 1..21: mol_type = other DNA
aataatactttgaatattttg

SEQ ID NO: 5716 - DNA, 21 bp, synthetic construct
  misc_feature 1..21: note = n-mer motif encoding polynucleotide
  source 1..21: mol_type = other DNA
gctagttatagtagtatggtg

SEQ ID NO: 5717 - DNA, 21 bp, synthetic construct
  misc_feature 1..21: note = n-mer motif encoding polynucleotide
  source 1..21: mol_type = other DNA
tcgggtcaaaacggtacatca

SEQ ID NO: 5718 - DNA, 21 bp, synthetic construct
  misc_feature 1..21: note = n-mer motif encoding polynucleotide
  source 1..21: mol_type = other DNA
ttgtctagtatgagtacggat

SEQ ID NO: 5719 - DNA, 21 bp, synthetic construct
  misc_feature 1..21: note = n-mer motif encoding polynucleotide
  source 1..21: mol_type = other DNA
gtcgcctcgatggtacacaac

SEQ ID NO: 5720 - DNA, 21 bp, synthetic construct
  misc_feature 1..21: note = n-mer motif encoding polynucleotide
  source 1..21: mol_type = other DNA
acgcaattgtcagacggctgc

SEQ ID NO: 5721 - DNA, 21 bp, synthetic construct
  misc_feature 1..21: note = n-mer motif encoding polynucleotide
  source 1..21: mol_type = other DNA
gcgattgtggatagggggagt

SEQ ID NO: 5722 - DNA, 21 bp, synthetic construct
  misc_feature 1..21: note = n-mer motif encoding polynucleotide
  source 1..21: mol_type = other DNA
aaccgtcaaagggacttcgaa

SEQ ID NO: 5723 - DNA, 21 bp, synthetic construct
  misc_feature 1..21: note = n-mer motif encoding polynucleotide
  source 1..21: mol_type = other DNA
gcacaccaaaaagacatacgc

SEQ ID NO: 5724 - DNA, 21 bp, synthetic construct
  misc_feature 1..21: note = n-mer motif encoding polynucleotide
  source 1..21: mol_type = other DNA
ttcaccgaacgcgcactccaa

SEQ ID NO: 5725 - DNA, 21 bp, synthetic construct
  misc_feature 1..21: note = n-mer motif encoding polynucleotide
  source 1..21: mol_type = other DNA
atgctgtctcatggtgcgctt

SEQ ID NO: 5726 - DNA, 21 bp, synthetic construct
  misc_feature 1..21: note = n-mer motif encoding polynucleotide
  source 1..21: mol_type = other DNA
tccgtaaccaacggagcggaa

SEQ ID NO: 5727 - DNA, 21 bp, synthetic construct
  misc_feature 1..21: note = n-mer motif encoding polynucleotide
  source 1..21: mol_type = other DNA
atcaccgccgcgtcaccgcaa

SEQ ID NO: 5728 - DNA, 21 bp, synthetic construct
  misc_feature 1..21: note = n-mer motif encoding polynucleotide
  source 1..21: mol_type = other DNA
caaaacacgcaacgatacttg

SEQ ID NO: 5729 - DNA, 21 bp, synthetic construct
  misc_feature 1..21: note = n-mer motif encoding polynucleotide
  source 1..21: mol_type = other DNA
actggccaaggattctcggca

SEQ ID NO: 5730 - DNA, 21 bp, synthetic construct
  misc_feature 1..21: note = n-mer motif encoding polynucleotide
  source 1..21: mol_type = other DNA
agttttgagaagaatggtatt

SEQ ID NO: 5731 - DNA, 21 bp, synthetic construct
  misc_feature 1..21: note = n-mer motif encoding polynucleotide
  source 1..21: mol_type = other DNA
ctcacgtcccactctgcgggc

SEQ ID NO: 5732 - DNA, 21 bp, synthetic construct
  misc_feature 1..21: note = n-mer motif encoding polynucleotide
  source 1..21: mol_type = other DNA
tctacaatcggcaacagcacg

SEQ ID NO: 5733 - DNA, 21 bp, synthetic construct
  misc_feature 1..21: note = n-mer motif encoding polynucleotide
  source 1..21: mol_type = other DNA
ggtcttagtcggaatgatggt

SEQ ID NO: 5734 - DNA, 21 bp, synthetic construct
  misc_feature 1..21: note = n-mer motif encoding polynucleotide
  source 1..21: mol_type = other DNA
tcgacgacgcacccttccgaa

SEQ ID NO: 5735 - DNA, 21 bp, synthetic construct
  misc_feature 1..21: note = n-mer motif encoding polynucleotide
  source 1..21: mol_type = other DNA
ccaagtacgaacgaaagccgc

SEQ ID NO: 5736 - DNA, 21 bp, synthetic construct
  misc_feature 1..21: note = n-mer motif encoding polynucleotide
  source 1..21: mol_type = other DNA
ggtacgaaggatattctgatt

SEQ ID NO: 5737 - DNA, 21 bp, synthetic construct
  misc_feature 1..21: note = n-mer motif encoding polynucleotide
  source 1..21: mol_type = other DNA
tctactattaatatgcgtgcg

SEQ ID NO: 5738 - DNA, 21 bp, synthetic construct
  misc_feature 1..21: note = n-mer motif encoding polynucleotide
  source 1..21: mol_type = other DNA
tatattgctgggggggagcag

SEQ ID NO: 5739 - DNA, 21 bp, synthetic construct
  misc_feature 1..21: note = n-mer motif encoding polynucleotide
  source 1..21: mol_type = other DNA
tccagcggccaaccgctcgtc

SEQ ID NO: 5740 - DNA, 21 bp, synthetic construct
  misc_feature 1..21: note = n-mer motif encoding polynucleotide
  source 1..21: mol_type = other DNA
gacaaacaacaaaccggacaa

SEQ ID NO: 5741 - DNA, 21 bp, synthetic construct
  misc_feature 1..21: note = n-mer motif encoding polynucleotide
  source 1..21: mol_type = other DNA
gggctaggacaaccccaactc

SEQ ID NO: 5742 - DNA, 21 bp, synthetic construct
  misc_feature 1..21: note = n-mer motif encoding polynucleotide
  source 1..21: mol_type = other DNA
agtccgcagcatggtgttatt

SEQ ID NO: 5743 - DNA, 21 bp, synthetic construct
  misc_feature 1..21: note = n-mer motif encoding polynucleotide
  source 1..21: mol_type = other DNA
tataggggtagggaggattgg

SEQ ID NO: 5744 - DNA, 21 bp, synthetic construct
  misc_feature 1..21: note = n-mer motif encoding polynucleotide
  source 1..21: mol_type = other DNA
gcggggggtttgctgtcgcgg

SEQ ID NO: 5745 - DNA, 21 bp, synthetic construct
  misc_feature 1..21: note = n-mer motif encoding polynucleotide
  source 1..21: mol_type = other DNA
ccgatacaacaagcctcattg

SEQ ID NO: 5746 - DNA, 21 bp, synthetic construct
  misc_feature 1..21: note = n-mer motif encoding polynucleotide
  source 1..21: mol_type = other DNA
tggagcgccggcgaacgggtg

SEQ ID NO: 5747 - DNA, 21 bp, synthetic construct
  misc_feature 1..21: note = n-mer motif encoding polynucleotide
  source 1..21: mol_type = other DNA
aggggtgatgttgctacgacg

SEQ ID NO: 5748 - DNA, 21 bp, synthetic construct
  misc_feature 1..21: note = n-mer motif encoding polynucleotide
  source 1..21: mol_type = other DNA
ttaacgggacaaaacgaattc

SEQ ID NO: 5749 - DNA, 21 bp, synthetic construct
  misc_feature 1..21: note = n-mer motif encoding polynucleotide
  source 1..21: mol_type = other DNA
acgacgccgcctttttctaat

SEQ ID NO: 5750 - DNA, 21 bp, synthetic construct
  misc_feature 1..21: note = n-mer motif encoding polynucleotide
  source 1..21: mol_type = other DNA
acgagtattggtagtgctaag

SEQ ID NO: 5751 - DNA, 21 bp, synthetic construct
  misc_feature 1..21: note = n-mer motif encoding polynucleotide
  source 1..21: mol_type = other DNA
aatgtgcagaatgtgcctggg

SEQ ID NO: 5752 - DNA, 21 bp, synthetic construct
  misc_feature 1..21: note = n-mer motif encoding polynucleotide
  source 1..21: mol_type = other DNA
tatacgggtactcttgttgtt

SEQ ID NO: 5753 - DNA, 21 bp, synthetic construct
  misc_feature 1..21: note = n-mer motif encoding polynucleotide
  source 1..21: mol_type = other DNA
ggaacccacgcctcagcatac

SEQ ID NO: 5754 - DNA, 21 bp, synthetic construct
  misc_feature 1..21: note = n-mer motif encoding polynucleotide
  source 1..21: mol_type = other DNA
ctggttgtttcgaatagtctg

SEQ ID NO: 5755 - DNA, 21 bp, synthetic construct
  misc_feature 1..21: note = n-mer motif encoding polynucleotide
  source 1..21: mol_type = other DNA
acgcatcttgtgagggattcg

SEQ ID NO: 5756 - DNA, 21 bp, synthetic construct
  misc_feature 1..21: note = n-mer motif encoding polynucleotide
  source 1..21: mol_type = other DNA
aatcatggtcgtgctattgat

SEQ ID NO: 5757 - DNA, 21 bp, synthetic construct
  misc_feature 1..21: note = n-mer motif encoding polynucleotide
  source 1..21: mol_type = other DNA
cccaaaactctaacttcgaca

SEQ ID NO: 5758 - DNA, 21 bp, synthetic construct
  misc_feature 1..21: note = n-mer motif encoding polynucleotide
  source 1..21: mol_type = other DNA
ttcggtatagggcacggaaca

SEQ ID NO: 5759 - DNA, 21 bp, synthetic construct
  misc_feature 1..21: note = n-mer motif encoding polynucleotide
  source 1..21: mol_type = other DNA
gcgcttccgtctcgtgagcgg

SEQ ID NO: 5760 - DNA, 21 bp, synthetic construct
  misc_feature 1..21: note = n-mer motif encoding polynucleotide
  source 1..21: mol_type = other DNA
gcgactaggggtgagtcgtct

SEQ ID NO: 5761 - DNA, 21 bp, synthetic construct
  misc_feature 1..21: note = n-mer motif encoding polynucleotide
  source 1..21: mol_type = other DNA
gggacaaccgaagttaacaaa

SEQ ID NO: 5762 - DNA, 21 bp, synthetic construct
  misc_feature 1..21: note = n-mer motif encoding polynucleotide
  source 1..21: mol_type = other DNA
acccacacccttgggggaaca

SEQ ID NO: 5763 - DNA, 21 bp, synthetic construct
  misc_feature 1..21: note = n-mer motif encoding polynucleotide
  source 1..21: mol_type = other DNA
gaagcagtaacaagtaaatgg

SEQ ID NO: 5764 - DNA, 21 bp, synthetic construct
  misc_feature 1..21: note = n-mer motif encoding polynucleotide
  source 1..21: mol_type = other DNA
cactacggtaacaaagacata

SEQ ID NO: 5765 - DNA, 21 bp, synthetic construct
  misc_feature 1..21: note = n-mer motif encoding polynucleotide
  source 1..21: mol_type = other DNA
atttctacgcatacgatgacg

SEQ ID NO: 5766 - DNA, 21 bp, synthetic construct
  misc_feature 1..21: note = n-mer motif encoding polynucleotide
  source 1..21: mol_type = other DNA
gatacgtataatagtaatact

SEQ ID NO: 5767 - DNA, 21 bp, synthetic construct
  misc_feature 1..21: note = n-mer motif encoding polynucleotide
  source 1..21: mol_type = other DNA
gtttttactgggcagacggag

SEQ ID NO: 5768 - DNA, 21 bp, synthetic construct
  misc_feature 1..21: note = n-mer motif encoding polynucleotide
  source 1..21: mol_type = other DNA
tcggtcaccagtggaacacaa

SEQ ID NO: 5769 - DNA, 21 bp, synthetic construct
  misc_feature 1..21: note = n-mer motif encoding polynucleotide
  source 1..21: mol_type = other DNA
catacgtattcgcaggctgat

SEQ ID NO: 5770 - DNA, 21 bp, synthetic construct
  misc_feature 1..21: note = n-mer motif encoding polynucleotide
  source 1..21: mol_type = other DNA
gtagcgggcttagtcgacata

SEQ ID NO: 5771 - DNA, 21 bp, synthetic construct
  misc_feature 1..21: note = n-mer motif encoding polynucleotide
  source 1..21: mol_type = other DNA
gactctaccaaagccatgcaa

SEQ ID NO: 5772 - DNA, 21 bp, synthetic construct
  misc_feature 1..21: note = n-mer motif encoding polynucleotide
  source 1..21: mol_type = other DNA
gaggggcataatcgtggtatt

SEQ ID NO: 5773 - DNA, 21 bp, synthetic construct
  misc_feature 1..21: note = n-mer motif encoding polynucleotide
  source 1..21: mol_type = other DNA
gggttgcatgggacgagtaat

SEQ ID NO: 5774 - DNA, 21 bp, synthetic construct
  misc_feature 1..21: note = n-mer motif encoding polynucleotide
  source 1..21: mol_type = other DNA
ccgctttctcttcataatagt

SEQ ID NO: 5775 - DNA, 21 bp, synthetic construct
  misc_feature 1..21: note = n-mer motif encoding polynucleotide
  source 1..21: mol_type = other DNA
gcgagtgataagggggcgaat

SEQ ID NO: 5776 - DNA, 21 bp, synthetic construct
  misc_feature 1..21: note = n-mer motif encoding polynucleotide
  source 1..21: mol_type = other DNA
gtgctgttgcagaattctcat

SEQ ID NO: 5777 - DNA, 21 bp, synthetic construct
  misc_feature 1..21: note = n-mer motif encoding polynucleotide
  source 1..21: mol_type = other DNA
ctatacgacggaaaacacgtc

SEQ ID NO: 5778 - DNA, 21 bp, synthetic construct
  misc_feature 1..21: note = n-mer motif encoding polynucleotide
  source 1..21: mol_type = other DNA
acccaaggatctaacaccaca

SEQ ID NO: 5779 - DNA, 21 bp, synthetic construct
  misc_feature 1..21: note = n-mer motif encoding polynucleotide
  source 1..21: mol_type = other DNA
ttcctcgacaaatacaactac

SEQ ID NO: 5780 - DNA, 21 bp, synthetic construct
  misc_feature 1..21: note = n-mer motif encoding polynucleotide
  source 1..21: mol_type = other DNA
gacaccggaatcaaaaacgtt

SEQ ID NO: 5781 - DNA, 21 bp, synthetic construct
  misc_feature 1..21: note = n-mer motif encoding polynucleotide
  source 1..21: mol_type = other DNA
tccggagcggcacaaaaccca

SEQ ID NO: 5782 - DNA, 21 bp, synthetic construct
  misc_feature 1..21: note = n-mer motif encoding polynucleotide
  source 1..21: mol_type = other DNA
accctccacaccaaagaccta

SEQ ID NO: 5783 - DNA, 21 bp, synthetic construct
  misc_feature 1..21: note = n-mer motif encoding polynucleotide
  source 1..21: mol_type = other DNA
gctacttacgttgtcggaaca

SEQ ID NO: 5784 - DNA, 21 bp, synthetic construct
  misc_feature 1..21: note = n-mer motif encoding polynucleotide
  source 1..21: mol_type = other DNA
cttgtggggactttggtgtat

SEQ ID NO: 5785 - DNA, 21 bp, synthetic construct
  misc_feature 1..21: note = n-mer motif encoding polynucleotide
  source 1..21: mol_type = other DNA
tctaatacgactgtgcagctt

SEQ ID NO: 5786 - DNA, 21 bp, synthetic construct
  misc_feature 1..21: note = n-mer motif encoding polynucleotide
  source 1..21: mol_type = other DNA
aaggctcagattaatcagatg

SEQ ID NO: 5787 - DNA, 21 bp, synthetic construct
  misc_feature 1..21: note = n-mer motif encoding polynucleotide
  source 1..21: mol_type = other DNA
cggaatgctactgtgactgtt

SEQ ID NO: 5788 - DNA, 21 bp, synthetic construct
  misc_feature 1..21: note = n-mer motif encoding polynucleotide
  source 1..21: mol_type = other DNA
gcaaccagagtgggcaaccac

SEQ ID NO: 5789 - DNA, 21 bp, synthetic construct
  misc_feature 1..21: note = n-mer motif encoding polynucleotide
  source 1..21: mol_type = other DNA
agttatcagaatcctccgcct

SEQ ID NO: 5790 - DNA, 21 bp, synthetic construct
  misc_feature 1..21: note = n-mer motif encoding polynucleotide
  source 1..21: mol_type = other DNA
tttgatagttataatattgtg

SEQ ID NO: 5791 - DNA, 21 bp, synthetic construct
  misc_feature 1..21: note = n-mer motif encoding polynucleotide
  source 1..21: mol_type = other DNA
gctactctttctccgcatgct

SEQ ID NO: 5792 - DNA, 21 bp, synthetic construct
  misc_feature 1..21: note = n-mer motif encoding polynucleotide
  source 1..21: mol_type = other DNA
tgggagagtccgactaatgcg

SEQ ID NO: 5793 - DNA, 21 bp, synthetic construct
  misc_feature 1..21: note = n-mer motif encoding polynucleotide
  source 1..21: mol_type = other DNA
atcgaaaacgtaaaccacttg

SEQ ID NO: 5794 - DNA, 21 bp, synthetic construct
  misc_feature 1..21: note = n-mer motif encoding polynucleotide
  source 1..21: mol_type = other DNA
tatcgggcttcggatgtggcg

SEQ ID NO: 5795 - DNA, 21 bp, synthetic construct
  misc_feature 1..21: note = n-mer motif encoding polynucleotide
  source 1..21: mol_type = other DNA
catatgtcttctgttgcgact

SEQ ID NO: 5796 - DNA, 21 bp, synthetic construct
  misc_feature 1..21: note = n-mer motif encoding polynucleotide
  source 1..21: mol_type = other DNA
atccaaagagacgtgggccac

SEQ ID NO: 5797 - DNA, 21 bp, synthetic construct
  misc_feature 1..21: note = n-mer motif encoding polynucleotide
  source 1..21: mol_type = other DNA
gagagtgttagggagactatt

SEQ ID NO: 5798 - DNA, 21 bp, synthetic construct
  misc_feature 1..21: note = n-mer motif encoding polynucleotide
  source 1..21: mol_type = other DNA
cagggggggaatagtcggttt

SEQ ID NO: 5799 - DNA, 21 bp, synthetic construct
  misc_feature 1..21: note = n-mer motif encoding polynucleotide
  source 1..21: mol_type = other DNA
gaaaaaggcacaccaagtagc

SEQ ID NO: 5800 - DNA, 21 bp, synthetic construct
  misc_feature 1..21: note = n-mer motif encoding polynucleotide
  source 1..21: mol_type = other DNA
cacgacagcacaacccgccca

SEQ ID NO: 5801 - DNA, 21 bp, synthetic construct
  misc_feature 1..21: note = n-mer motif encoding polynucleotide
  source 1..21: mol_type = other DNA
ttaccaacaggcgtcctgccc

SEQ ID NO: 5802 - DNA, 21 bp, synthetic construct
  misc_feature 1..21: note = n-mer motif encoding polynucleotide
  source 1..21: mol_type = other DNA
accctaggctacccagacaaa

SEQ ID NO: 5803 - DNA, 21 bp, synthetic construct
  misc_feature 1..21: note = n-mer motif encoding polynucleotide
  source 1..21: mol_type = other DNA
gctaacaccgtcacagaacga

SEQ ID NO: 5804 - DNA, 21 bp, synthetic construct
  misc_feature 1..21: note = n-mer motif encoding polynucleotide
  source 1..21: mol_type = other DNA
cacgacaaatctatccaacca

SEQ ID NO: 5805 - DNA, 21 bp, synthetic construct
  misc_feature 1..21: note = n-mer motif encoding polynucleotide
  source 1..21: mol_type = other DNA
ggaggaacagcccttgggagc

SEQ ID NO: 5806 - DNA, 21 bp, synthetic construct
  misc_feature 1..21: note = n-mer motif encoding polynucleotide
  source 1..21: mol_type = other DNA
gggggtaactaccacaccact

SEQ ID NO: 5807 - DNA, 21 bp, synthetic construct
  misc_feature 1..21: note = n-mer motif encoding polynucleotide
  source 1..21: mol_type = other DNA
atctcagaaatgactaggtac

SEQ ID NO: 5808 - DNA, 21 bp, synthetic construct
  misc_feature 1..21: note = n-mer motif encoding polynucleotide
  source 1..21: mol_type = other DNA
gttgaatctaaatccgaacca

SEQ ID NO: 5809 - DNA, 21 bp, synthetic construct
  misc_feature 1..21: note = n-mer motif encoding polynucleotide
  source 1..21: mol_type = other DNA
gaccgtgcccaaaacaacgaa

SEQ ID NO: 5810 - DNA, 21 bp, synthetic construct
  misc_feature 1..21: note = n-mer motif encoding polynucleotide
  source 1..21: mol_type = other DNA
acggcgcagaccggctgggtt

SEQ ID NO: 5811 - DNA, 21 bp, synthetic construct
  misc_feature 1..21: note = n-mer motif encoding polynucleotide
  source 1..21: mol_type = other DNA
gggttcgggcacctgcccgaa

SEQ ID NO: 5812 - DNA, 21 bp, synthetic construct
  misc_feature 1..21: note = n-mer motif encoding polynucleotide
  source 1..21: mol_type = other DNA
cctattacgggttttagtgtt

SEQ ID NO: 5813 - DNA, 21 bp, synthetic construct
  misc_feature 1..21: note = n-mer motif encoding polynucleotide
  source 1..21: mol_type = other DNA
gataggacgtattcgaatacg

SEQ ID NO: 5814 - DNA, 21 bp, synthetic construct
  misc_feature 1..21: note = n-mer motif encoding polynucleotide
  source 1..21: mol_type = other DNA
atgtcaaacgcctcctacata

SEQ ID NO: 5815 - DNA, 21 bp, synthetic construct
  misc_feature 1..21: note = n-mer motif encoding polynucleotide
  source 1..21: mol_type = other DNA
gataatagtaggcctgaggtg

SEQ ID NO: 5816 - DNA, 21 bp, synthetic construct
  misc_feature 1..21: note = n-mer motif encoding polynucleotide
  source 1..21: mol_type = other DNA
tcaagttcccaaacggttttg

SEQ ID NO: 5817 - DNA, 21 bp, synthetic construct
  misc_feature 1..21: note = n-mer motif encoding polynucleotide
  source 1..21: mol_type = other DNA
agtaatcttgatggtactatt

SEQ ID NO: 5818 - DNA, 21 bp, synthetic construct
  misc_feature 1..21: note = n-mer motif encoding polynucleotide
  source 1..21: mol_type = other DNA
agtaatatgcgtgaggagatt

SEQ ID NO: 5819 - DNA, 21 bp, synthetic construct
  misc_feature 1..21: note = n-mer motif encoding polynucleotide
  source 1..21: mol_type = other DNA
agacttacagaactggtcata

SEQ ID NO: 5820 - DNA, 21 bp, synthetic construct
  misc_feature 1..21: note = n-mer motif encoding polynucleotide
  source 1..21: mol_type = other DNA
caggttagtctggtgaagttg

SEQ ID NO: 5821 - DNA, 21 bp, synthetic construct
  misc_feature 1..21: note = n-mer motif encoding polynucleotide
  source 1..21: mol_type = other DNA
gaaatacacacgaccacaggc

SEQ ID NO: 5822 - DNA, 21 bp, synthetic construct
  misc_feature 1..21: note = n-mer motif encoding polynucleotide
  source 1..21: mol_type = other DNA
agcaggatagaaaacaacaac

SEQ ID NO: 5823 - DNA, 21 bp, synthetic construct
  misc_feature 1..21: note = n-mer motif encoding polynucleotide
  source 1..21: mol_type = other DNA
ggaacaggcaaagaagttcga

SEQ ID NO: 5824 - DNA, 21 bp, synthetic construct
  misc_feature 1..21: note = n-mer motif encoding polynucleotide
  source 1..21: mol_type = other DNA
tggcaggatcataataaggtg

SEQ ID NO: 5825 - DNA, 21 bp, synthetic construct
  misc_feature 1..21: note = n-mer motif encoding polynucleotide
  source 1..21: mol_type = other DNA
tcgacaaactctataggcgcc

SEQ ID NO: 5826 - DNA, 21 bp, synthetic construct
  misc_feature 1..21: note = n-mer motif encoding polynucleotide
  source 1..21: mol_type = other DNA
tccgaattaatggtcagaccc

SEQ ID NO: 5827 - DNA, 21 bp, synthetic construct
  misc_feature 1..21: note = n-mer motif encoding polynucleotide
  source 1..21: mol_type = other DNA
ccgcttcagaataataagacg

SEQ ID NO: 5828 - DNA, 21 bp, synthetic construct
  misc_feature 1..21: note = n-mer motif encoding polynucleotide
  source 1..21: mol_type = other DNA
ccttatgcgaataggcttgag

SEQ ID NO: 5829 - DNA, 21 bp, synthetic construct
  misc_feature 1..21: note = n-mer motif encoding polynucleotide
  source 1..21: mol_type = other DNA
gggacggtttcgcttattcct

SEQ ID NO: 5830 - DNA, 21 bp, synthetic construct
  misc_feature 1..21: note = n-mer motif encoding polynucleotide
  source 1..21: mol_type = other DNA
gatgtttatcttaagagtccg

SEQ ID NO: 5831 - DNA, 21 bp, synthetic construct
  misc_feature 1..21: note = n-mer motif encoding polynucleotide
  source 1..21: mol_type = other DNA
ttgccggataaggggcggatt

SEQ ID NO: 5832 - DNA, 21 bp, synthetic construct
  misc_feature 1..21: note = n-mer motif encoding polynucleotide
  source 1..21: mol_type = other DNA
tcgataacgaccgtagcgaac

SEQ ID NO: 5833 - DNA, 21 bp, synthetic construct
  misc_feature 1..21: note = n-mer motif encoding polynucleotide
  source 1..21: mol_type = other DNA
ccgcttcaatcccaatcggga

SEQ ID NO: 5834 - DNA, 21 bp, synthetic construct
  misc_feature 1..21: note = n-mer motif encoding polynucleotide
  source 1..21: mol_type = other DNA
aataatatgggtcatggtcat

SEQ ID NO: 5835 - DNA, 21 bp, synthetic construct
  misc_feature 1..21: note = n-mer motif encoding polynucleotide
  source 1..21: mol_type = other DNA
agcggacaaaaaaactcagaa

SEQ ID NO: 5836 - DNA, 21 bp, synthetic construct
  misc_feature 1..21: note = n-mer motif encoding polynucleotide
  source 1..21: mol_type = other DNA
accgaagcgggccgcccccaa

SEQ ID NO: 5837 - DNA, 21 bp, synthetic construct
  misc_feature 1..21: note = n-mer motif encoding polynucleotide
  source 1..21: mol_type = other DNA
accttacacacgaaagacttg

SEQ ID NO: 5838 - DNA, 21 bp, synthetic construct
  misc_feature 1..21: note = n-mer motif encoding polynucleotide
  source 1..21: mol_type = other DNA
cttcgagacctaaacggagga

SEQ ID NO: 5839 - DNA, 21 bp, synthetic construct
  misc_feature 1..21: note = n-mer motif encoding polynucleotide
  source 1..21: mol_type = other DNA
gtttgtgttactacttgtgct

SEQ ID NO: 5840 - DNA, 21 bp, synthetic construct
  misc_feature 1..21: note = n-mer motif encoding polynucleotide
  source 1..21: mol_type = other DNA
gtcacagctgctcaaccccaa

SEQ ID NO: 5841 - DNA, 21 bp, synthetic construct
  misc_feature 1..21: note = n-mer motif encoding polynucleotide
  source 1..21: mol_type = other DNA
gcgacttttagtcatgctggt

SEQ ID NO: 5842 - DNA, 21 bp, synthetic construct
  misc_feature 1..21: note = n-mer motif encoding polynucleotide
  source 1..21: mol_type = other DNA
acttatgcgcctaggtcgcct

SEQ ID NO: 5843 - DNA, 21 bp, synthetic construct
  misc_feature 1..21: note = n-mer motif encoding polynucleotide
  source 1..21: mol_type = other DNA
acgtcggagatgcgtactgct

SEQ ID NO: 5844 - DNA, 21 bp, synthetic construct
  misc_feature 1..21: note = n-mer motif encoding polynucleotide
  source 1..21: mol_type = other DNA
tactcgacaaccatgcttaac

SEQ ID NO: 5845 - DNA, 21 bp, synthetic construct
  misc_feature 1..21: note = n-mer motif encoding polynucleotide
  source 1..21: mol_type = other DNA
tctttcacgaacacaaaccca

SEQ ID NO: 5846 - DNA, 21 bp, synthetic construct
  misc_feature 1..21: note = n-mer motif encoding polynucleotide
  source 1..21: mol_type = other DNA
agtcctcctagtacgtcgggt

SEQ ID NO: 5847 - DNA, 21 bp, synthetic construct
  misc_feature 1..21: note = n-mer motif encoding polynucleotide
  source 1..21: mol_type = other DNA
gtgacgactgttgatagtgct

SEQ ID NO: 5848 - DNA, 21 bp, synthetic construct
  misc_feature 1..21: note = n-mer motif encoding polynucleotide
  source 1..21: mol_type = other DNA
gaggcgcataatcgtgttatt

SEQ ID NO: 5849 - DNA, 21 bp, synthetic construct
  misc_feature 1..21: note = n-mer motif encoding polynucleotide
  source 1..21: mol_type = other DNA
atggagttgacttctactagt

SEQ ID NO: 5850 - DNA, 21 bp, synthetic construct
  misc_feature 1..21: note = n-mer motif encoding polynucleotide
  source 1..21: mol_type = other DNA
catttggttactagtggtatt

SEQ ID NO: 5851 - DNA, 21 bp, synthetic construct
  misc_feature 1..21: note = n-mer motif encoding polynucleotide
  source 1..21: mol_type = other DNA
caaaccatcacctcacaaatg

SEQ ID NO: 5852 - DNA, 21 bp, synthetic construct
  misc_feature 1..21: note = n-mer motif encoding polynucleotide
  source 1..21: mol_type = other DNA
actgcgaatagtacgtatgtg

SEQ ID NO: 5853 - DNA, 21 bp, synthetic construct
  misc_feature 1..21: note = n-mer motif encoding polynucleotide
  source 1..21: mol_type = other DNA
cttatccaattatcgggtcaa

SEQ ID NO: 5854 - DNA, 21 bp, synthetic construct
  misc_feature 1..21: note = n-mer motif encoding polynucleotide
  source 1..21: mol_type = other DNA
tcttacgttagcgtccccgcc

SEQ ID NO: 5855 - DNA, 21 bp, synthetic construct
  misc_feature 1..21: note = n-mer motif encoding polynucleotide
  source 1..21: mol_type = other DNA
gtgcatgggaatgctccggct

SEQ ID NO: 5856 - DNA, 21 bp, synthetic construct
  misc_feature 1..21: note = n-mer motif encoding polynucleotide
  source 1..21: mol_type = other DNA
gccggaaaaacccacgccgac

SEQ ID NO: 5857 - DNA, 21 bp, synthetic construct
  misc_feature 1..21: note = n-mer motif encoding polynucleotide
  source 1..21: mol_type = other DNA
acattccaccaaggggtcaaa

SEQ ID NO: 5858 - DNA, 21 bp, synthetic construct
  misc_feature 1..21: note = n-mer motif encoding polynucleotide
  source 1..21: mol_type = other DNA
ttaggaaacaaccggccacta

SEQ ID NO: 5859 - DNA, 21 bp, synthetic construct
  misc_feature 1..21: note = n-mer motif encoding polynucleotide
  source 1..21: mol_type = other DNA
ctgcacctcgtccggagcttc

SEQ ID NO: 5860 - DNA, 21 bp, synthetic construct
  misc_feature 1..21: note = n-mer motif encoding polynucleotide
  source 1..21: mol_type = other DNA
tcctacagtacttcaacaccg

SEQ ID NO: 5861 - DNA, 21 bp, synthetic construct
  misc_feature 1..21: note = n-mer motif encoding polynucleotide
  source 1..21: mol_type = other DNA
atatcgcaaggctcgagcctc

SEQ ID NO: 5862 - DNA, 21 bp, synthetic construct
  misc_feature 1..21: note = n-mer motif encoding polynucleotide
  source 1..21: mol_type = other DNA
ctccaactggctacatcccac

SEQ ID NO: 5863 - DNA, 21 bp, synthetic construct
  misc_feature 1..21: note = n-mer motif encoding polynucleotide
  source 1..21: mol_type = other DNA
gtgactcagcggtttgctgag

SEQ ID NO: 5864 - DNA, 21 bp, synthetic construct
  misc_feature 1..21: note = n-mer motif encoding polynucleotide
  source 1..21: mol_type = other DNA
gctatagactccatcaaaatg

SEQ ID NO: 5865 - DNA, 21 bp, synthetic construct
  misc_feature 1..21: note = n-mer motif encoding polynucleotide
  source 1..21: mol_type = other DNA
gacgcacacactttcagccgg

SEQ ID NO: 5866 - DNA, 21 bp, synthetic construct
  misc_feature 1..21: note = n-mer motif encoding polynucleotide
  source 1..21: mol_type = other DNA
cgtggttcagacggaggattg

SEQ ID NO: 5867 - DNA, 21 bp, synthetic construct
  misc_feature 1..21: note = n-mer motif encoding polynucleotide
  source 1..21: mol_type = other DNA
ttagcacaaggcacggaccgg

SEQ ID NO: 5868 - DNA, 21 bp, synthetic construct
  misc_feature 1..21: note = n-mer motif encoding polynucleotide
  source 1..21: mol_type = other DNA
aaaaacaacaactcagacagt

SEQ ID NO: 5869 - DNA, 21 bp, synthetic construct
  misc_feature 1..21: note = n-mer motif encoding polynucleotide
  source 1..21: mol_type = other DNA
gaaaacgaaaaacgagaaagc

SEQ ID NO: 5870 - DNA, 21 bp, synthetic construct
  misc_feature 1..21: note = n-mer motif encoding polynucleotide
  source 1..21: mol_type = other DNA
aacgaacaattcgaaaaagtc

SEQ ID NO: 5871 - DNA, 21 bp, synthetic construct
  misc_feature 1..21: note = n-mer motif encoding polynucleotide
  source 1..21: mol_type = other DNA
acacaagtagtcgcaagaaca

SEQ ID NO: 5872 - DNA, 21 bp, synthetic construct
  misc_feature 1..21: note = n-mer motif encoding polynucleotide
  source 1..21: mol_type = other DNA
ggagtaaacgtcaccaacagc

SEQ ID NO: 5873 - DNA, 21 bp, synthetic construct
  misc_feature 1..21: note = n-mer motif encoding polynucleotide
  source 1..21: mol_type = other DNA
gccgacaaaggattcggccac

SEQ ID NO: 5874 - DNA, 21 bp, synthetic construct
  misc_feature 1..21: note = n-mer motif encoding polynucleotide
  source 1..21: mol_type = other DNA
actcataagcaggtggatctt

SEQ ID NO: 5875 - DNA, 21 bp, synthetic construct
  misc_feature 1..21: note = n-mer motif encoding polynucleotide
  source 1..21: mol_type = other DNA
tcggctaacttatacaaacaa

SEQ ID NO: 5876 - DNA, 21 bp, synthetic construct
  misc_feature 1..21: note = n-mer motif encoding polynucleotide
  source 1..21: mol_type = other DNA
aagctgcatactaaggatctt

SEQ ID NO: 5877 - DNA, 21 bp, synthetic construct
  misc_feature 1..21: note = n-mer motif encoding polynucleotide
  source 1..21: mol_type = other DNA
gtggtggttcacactatccca

SEQ ID NO: 5878 - DNA, 21 bp, synthetic construct
  misc_feature 1..21: note = n-mer motif encoding polynucleotide
  source 1..21: mol_type = other DNA
tctacgtctcaggctgtgcag

SEQ ID NO: 5879 - DNA, 21 bp, synthetic construct
  misc_feature 1..21: note = n-mer motif encoding polynucleotide
  source 1..21: mol_type = other DNA
cgtaacggctccgcccaaagc

SEQ ID NO: 5880 - DNA, 21 bp, synthetic construct
  misc_feature 1..21: note = n-mer motif encoding polynucleotide
  source 1..21: mol_type = other DNA
cattatgggaataaggatatt

SEQ ID NO: 5881 - DNA, 21 bp, synthetic construct
  misc_feature 1..21: note = n-mer motif encoding polynucleotide
  source 1..21: mol_type = other DNA
agcttcttggtagcccaccca

SEQ ID NO: 5882 - DNA, 21 bp, synthetic construct
  misc_feature 1..21: note = n-mer motif encoding polynucleotide
  source 1..21: mol_type = other DNA
cagcagaatacgagtttgccg

SEQ ID NO: 5883 - DNA, 21 bp, synthetic construct
  misc_feature 1..21: note = n-mer motif encoding polynucleotide
  source 1..21: mol_type = other DNA
atgcacgtcgacaaaacgagt

SEQ ID NO: 5884 - DNA, 21 bp, synthetic construct
  misc_feature 1..21: note = n-mer motif encoding polynucleotide
  source 1..21: mol_type = other DNA
aataatgagaatacgcgtaat

SEQ ID NO: 5885 - DNA, 21 bp, synthetic construct
  misc_feature 1..21: note = n-mer motif encoding polynucleotide
  source 1..21: mol_type = other DNA
tcgataaacaacataggcgca

SEQ ID NO: 5886 - DNA, 21 bp, synthetic construct
  misc_feature 1..21: note = n-mer motif encoding polynucleotide
  source 1..21: mol_type = other DNA
gctactatatcggaccgagcc

SEQ ID NO: 5887 - DNA, 21 bp, synthetic construct
  misc_feature 1..21: note = n-mer motif encoding polynucleotide
  source 1..21: mol_type = other DNA
tactcaaacctcgtactttcc

SEQ ID NO: 5888 - DNA, 21 bp, synthetic construct
  misc_feature 1..21: note = n-mer motif encoding polynucleotide
  source 1..21: mol_type = other DNA
atgatgaatgtgagtggtcat

SEQ ID NO: 5889 - DNA, 21 bp, synthetic construct
  misc_feature 1..21: note = n-mer motif encoding polynucleotide
  source 1..21: mol_type = other DNA
ggggagacgcggtcgactgct

SEQ ID NO: 5890 - DNA, 21 bp, synthetic construct
  misc_feature 1..21: note = n-mer motif encoding polynucleotide
  source 1..21: mol_type = other DNA
acgaagggttataatgatctt

SEQ ID NO: 5891 - DNA, 21 bp, synthetic construct
  misc_feature 1..21: note = n-mer motif encoding polynucleotide
  source 1..21: mol_type = other DNA
gcgtataatatgtcgtctgtt

SEQ ID NO: 5892 - DNA, 21 bp, synthetic construct
  misc_feature 1..21: note = n-mer motif encoding polynucleotide
  source 1..21: mol_type = other DNA
gcagaccccgctaaaggcaaa

SEQ ID NO: 5893 - DNA, 21 bp, synthetic construct
  misc_feature 1..21: note = n-mer motif encoding polynucleotide
  source 1..21: mol_type = other DNA
tatatttcggcgcctccgatg

SEQ ID NO: 5894 - DNA, 21 bp, synthetic construct
  misc_feature 1..21: note = n-mer motif encoding polynucleotide
  source 1..21: mol_type = other DNA
cgaaacaacccatcgcacgac

SEQ ID NO: 5895 - DNA, 21 bp, synthetic construct
  misc_feature 1..21: note = n-mer motif encoding polynucleotide
  source 1..21: mol_type = other DNA
ggaacctccatagactacgta

SEQ ID NO: 5896 - DNA, 21 bp, synthetic construct
  misc_feature 1..21: note = n-mer motif encoding polynucleotide
  source 1..21: mol_type = other DNA
ggcaccgggtacccaaaccaa

SEQ ID NO: 5897 - DNA, 21 bp, synthetic construct
  misc_feature 1..21: note = n-mer motif encoding polynucleotide
  source 1..21: mol_type = other DNA
gatcatatgaatttgaggtct

SEQ ID NO: 5898 - DNA, 21 bp, synthetic construct
  misc_feature 1..21: note = n-mer motif encoding polynucleotide
  source 1..21: mol_type = other DNA
attaattcgtatttgcatgag

SEQ ID NO: 5899 - DNA, 21 bp, synthetic construct
  misc_feature 1..21: note = n-mer motif encoding polynucleotide
  source 1..21: mol_type = other DNA
tggcaaatgggggccgggagc

SEQ ID NO: 5900 - DNA, 21 bp, synthetic construct
  misc_feature 1..21: note = n-mer motif encoding polynucleotide
  source 1..21: mol_type = other DNA
atgggtatcgggtcatacaaa

SEQ ID NO: 5901 - DNA, 21 bp, synthetic construct
  misc_feature 1..21: note = n-mer motif encoding polynucleotide
  source 1..21: mol_type = other DNA
caaaaccacaacgaactaaaa

SEQ ID NO: 5902 - DNA, 21 bp, synthetic construct
  misc_feature 1..21: note = n-mer motif encoding polynucleotide
  source 1..21: mol_type = other DNA
gataagtctaattatagtatt

SEQ ID NO: 5903 - DNA, 21 bp, synthetic construct
  misc_feature 1..21: note = n-mer motif encoding polynucleotide
  source 1..21: mol_type = other DNA
acaacgaaaccggtcgcggaa

SEQ ID NO: 5904 - DNA, 21 bp, synthetic construct
  misc_feature 1..21: note = n-mer motif encoding polynucleotide
  source 1..21: mol_type = other DNA
gtgactgtgagtaatagtctg

SEQ ID NO: 5905 - DNA, 21 bp, synthetic construct
  misc_feature 1..21: note = n-mer motif encoding polynucleotide
  source 1..21: mol_type = other DNA
acggcgtatctggatggtctg

SEQ ID NO: 5906 - DNA, 21 bp, synthetic construct
  misc_feature 1..21: note = n-mer motif encoding polynucleotide
  source 1..21: mol_type = other DNA
aatttgcagactggtgttcag

SEQ ID NO: 5907 - DNA, 21 bp, synthetic construct
  misc_feature 1..21: note = n-mer motif encoding polynucleotide
  source 1..21: mol_type = other DNA
accgtcgctccctacagtagc

SEQ ID NO: 5908 - DNA, 21 bp, synthetic construct
  misc_feature 1..21: note = n-mer motif encoding polynucleotide
  source 1..21: mol_type = other DNA
gttcagatttctatgaataat

SEQ ID NO: 5909 - DNA, 21 bp, synthetic construct
  misc_feature 1..21: note = n-mer motif encoding polynucleotide
  source 1..21: mol_type = other DNA
tacatagcaggtggtgaacaa

SEQ ID NO: 5910 - DNA, 21 bp, synthetic construct
  misc_feature 1..21: note = n-mer motif encoding polynucleotide
  source 1..21: mol_type = other DNA
ttcatggaagtcatgaaaaac

SEQ ID NO: 5911 - DNA, 21 bp, synthetic construct
  misc_feature 1..21: note = n-mer motif encoding polynucleotide
  source 1..21: mol_type = other DNA
acgactgataagggtattaat

SEQ ID NO: 5912 - DNA, 21 bp, synthetic construct
  misc_feature 1..21: note = n-mer motif encoding polynucleotide
  source 1..21: mol_type = other DNA
ttgagctacagcatccaacac

SEQ ID NO: 5913 - DNA, 21 bp, synthetic construct
  misc_feature 1..21: note = n-mer motif encoding polynucleotide
  source 1..21: mol_type = other DNA
gcttataatgctcgtctgcct

SEQ ID NO: 5914 - DNA, 21 bp, synthetic construct
  misc_feature 1..21: note = n-mer motif encoding polynucleotide
  source 1..21: mol_type = other DNA
aacaccggcaccacgagtgtc

SEQ ID NO: 5915 - DNA, 21 bp, synthetic construct
  misc_feature 1..21: note = n-mer motif encoding polynucleotide
  source 1..21: mol_type = other DNA
gtgctgagtacggggctgcgg

SEQ ID NO: 5916 - DNA, 21 bp, synthetic construct
  misc_feature 1..21: note = n-mer motif encoding polynucleotide
  source 1..21: mol_type = other DNA
aacgactcctcgtcaatgtcc

SEQ ID NO: 5917 - DNA, 21 bp, synthetic construct
  misc_feature 1..21: note = n-mer motif encoding polynucleotide
  source 1..21: mol_type = other DNA
cgccaaggcagcttgatgata

SEQ ID NO: 5918 - DNA, 21 bp, synthetic construct
  misc_feature 1..21: note = n-mer motif encoding polynucleotide
  source 1..21: mol_type = other DNA
atcagcaccgcatacatgttg

SEQ ID NO: 5919 - DNA, 21 bp, synthetic construct
  misc_feature 1..21: note = n-mer motif encoding polynucleotide
  source 1..21: mol_type = other DNA
ggtactatgaatattggtatt

SEQ ID NO: 5920 - DNA, 21 bp, synthetic construct
  misc_feature 1..21: note = n-mer motif encoding polynucleotide
  source 1..21: mol_type = other DNA
cataataataatttgctgaat

SEQ ID NO: 5921 - DNA, 21 bp, synthetic construct
  misc_feature 1..21: note = n-mer motif encoding polynucleotide
  source 1..21: mol_type = other DNA
catttttcgcagattactaat

SEQ ID NO: 5922 - DNA, 21 bp, synthetic construct
  misc_feature 1..21: note = n-mer motif encoding polynucleotide
  source 1..21: mol_type = other DNA
gacctgaccagagctgcaata

SEQ ID NO: 5923 - DNA, 21 bp, synthetic construct
  misc_feature 1..21: note = n-mer motif encoding polynucleotide
  source 1..21: mol_type = other DNA
gtcgctatgggaggcggtccc

SEQ ID NO: 5924 - DNA, 21 bp, synthetic construct
  misc_feature 1..21: note = n-mer motif encoding polynucleotide
  source 1..21: mol_type = other DNA
gcctacggtatcagagaagtg

SEQ ID NO: 5925 - DNA, 21 bp, synthetic construct
  misc_feature 1..21: note = n-mer motif encoding polynucleotide
  source 1..21: mol_type = other DNA
acatcagacggtctactaagt

SEQ ID NO: 5926 - DNA, 21 bp, synthetic construct
  misc_feature 1..21: note = n-mer motif encoding polynucleotide
  source 1..21: mol_type = other DNA
acgatggctacaaacttaagt

SEQ ID NO: 5927 - DNA, 21 bp, synthetic construct
  misc_feature 1..21: note = n-mer motif encoding polynucleotide
  source 1..21: mol_type = other DNA
aacaacggcaactcatcaagg

SEQ ID NO: 5928 - DNA, 21 bp, synthetic construct
  misc_feature 1..21: note = n-mer motif encoding polynucleotide
  source 1..21: mol_type = other DNA
acggagaaggcgagtcctctg

SEQ ID NO: 5929 - DNA, 21 bp, synthetic construct
  misc_feature 1..21: note = n-mer motif encoding polynucleotide
  source 1..21: mol_type = other DNA
ctcaaccacacaatgcccctc

SEQ ID NO: 5930 - DNA, 21 bp, synthetic construct
  misc_feature 1..21: note = n-mer motif encoding polynucleotide
  source 1..21: mol_type = other DNA
gatacggcgagttataataat

SEQ ID NO: 5931 - DNA, 21 bp, synthetic construct
  misc_feature 1..21: note = n-mer motif encoding polynucleotide
  source 1..21: mol_type = other DNA
aacatgaccaacgaacggctc

SEQ ID NO: 5932 - DNA, 21 bp, synthetic construct
  misc_feature 1..21: note = n-mer motif encoding polynucleotide
  source 1..21: mol_type = other DNA
gtagtctcatcgggcggctgg

SEQ ID NO: 5933 - DNA, 21 bp, synthetic construct
  misc_feature 1..21: note = n-mer motif encoding polynucleotide
  source 1..21: mol_type = other DNA
gtgaatcagagtcctggggct

SEQ ID NO: 5934 - DNA, 21 bp, synthetic construct
  misc_feature 1..21: note = n-mer motif encoding polynucleotide
  source 1..21: mol_type = other DNA
gatcatcatcctcagagtcgt

SEQ ID NO: 5935 - DNA, 21 bp, synthetic construct
  misc_feature 1..21: note = n-mer motif encoding polynucleotide
  source 1..21: mol_type = other DNA
cgatggcaaggactgagcgcg

SEQ ID NO: 5936 - DNA, 21 bp, synthetic construct
  misc_feature 1..21: note = n-mer motif encoding polynucleotide
  source 1..21: mol_type = other DNA
gcggttacgacaagcgtgagg

SEQ ID NO: 5937 - DNA, 21 bp, synthetic construct
  misc_feature 1..21: note = n-mer motif encoding polynucleotide
  source 1..21: mol_type = other DNA
tggggagtcagtaactcagca

SEQ ID NO: 5938 - DNA, 21 bp, synthetic construct
  misc_feature 1..21: note = n-mer motif encoding polynucleotide
  source 1..21: mol_type = other DNA
gcgcatatgcattcggagttg

SEQ ID NO: 5939 - DNA, 21 bp, synthetic construct
  misc_feature 1..21: note = n-mer motif encoding polynucleotide
  source 1..21: mol_type = other DNA
aataatcttacgaattcgacg

SEQ ID NO: 5940 - DNA, 21 bp, synthetic construct
  misc_feature 1..21: note = n-mer motif encoding polynucleotide
  source 1..21: mol_type = other DNA
agtagtgggggtatgaaggcg

SEQ ID NO: 5941 - DNA, 21 bp, synthetic construct
  misc_feature 1..21: note = n-mer motif encoding polynucleotide
  source 1..21: mol_type = other DNA
gttgggtatggggagcatgtt

SEQ ID NO: 5942 - DNA, 21 bp, synthetic construct
  misc_feature 1..21: note = n-mer motif encoding polynucleotide
  source 1..21: mol_type = other DNA
accatagtgtccacttcttac

SEQ ID NO: 5943 - DNA, 21 bp, synthetic construct
  misc_feature 1..21: note = n-mer motif encoding polynucleotide
  source 1..21: mol_type = other DNA
cccaccagtcaccaagaaccc

SEQ ID NO: 5944 - DNA, 21 bp, synthetic construct
  misc_feature 1..21: note = n-mer motif encoding polynucleotide
  source 1..21: mol_type = other DNA
tctaaccttcgaaacacaata

SEQ ID NO: 5945 - DNA, 21 bp, synthetic construct
  misc_feature 1..21: note = n-mer motif encoding polynucleotide
  source 1..21: mol_type = other DNA
tcaagacacgacgtccgaaac

SEQ ID NO: 5946 - DNA, 21 bp, synthetic construct
  misc_feature 1..21: note = n-mer motif encoding polynucleotide
  source 1..21: mol_type = other DNA
cagatgaatattcatgataag

SEQ ID NO: 5947 - DNA, 21 bp, synthetic construct
  misc_feature 1..21: note = n-mer motif encoding polynucleotide
  source 1..21: mol_type = other DNA
tgggctatgaataatgtgccg

SEQ ID NO: 5948 - DNA, 21 bp, synthetic construct
  misc_feature 1..21: note = n-mer motif encoding polynucleotide
  source 1..21: mol_type = other DNA
gcgatggatgggtatagggtt

SEQ ID NO: 5949 - DNA, 21 bp, synthetic construct
  misc_feature 1..21: note = n-mer motif encoding polynucleotide
  source 1..21: mol_type = other DNA
aaagggggaaacctcaccgca

SEQ ID NO: 5950 - DNA, 21 bp, synthetic construct
  misc_feature 1..21: note = n-mer motif encoding polynucleotide
  source 1..21: mol_type = other DNA
attggtaaggatagtgttccg

SEQ ID NO: 5951 - DNA, 21 bp, synthetic construct
  misc_feature 1..21: note = n-mer motif encoding polynucleotide
  source 1..21: mol_type = other DNA
gtgcagttgacgcataatggg

SEQ ID NO: 5952 - DNA, 21 bp, synthetic construct
  misc_feature 1..21: note = n-mer motif encoding polynucleotide
  source 1..21: mol_type = other DNA
ggcctgaaccagatcacatcg

SEQ ID NO: 5953 - DNA, 21 bp, synthetic construct
  misc_feature 1..21: note = n-mer motif encoding polynucleotide
  source 1..21: mol_type = other DNA
aggggtgatccttctacgcct

SEQ ID NO: 5954 - DNA, 21 bp, synthetic construct
  misc_feature 1..21: note = n-mer motif encoding polynucleotide
  source 1..21: mol_type = other DNA
gttccctccgacccccactgg

SEQ ID NO: 5955 - DNA, 21 bp, synthetic construct
  misc_feature 1..21: note = n-mer motif encoding polynucleotide
  source 1..21: mol_type = other DNA
acgttaagttcccaagtcaca

SEQ ID NO: 5956 - DNA, 21 bp, synthetic construct
  misc_feature 1..21: note = n-mer motif encoding polynucleotide
  source 1..21: mol_type = other DNA
aaccaaagagttgaacaaaaa

SEQ ID NO: 5957 - DNA, 21 bp, synthetic construct
  misc_feature 1..21: note = n-mer motif encoding polynucleotide
  source 1..21: mol_type = other DNA
gtacttccaagtcggatcgcg

SEQ ID NO: 5958 - DNA, 21 bp, synthetic construct
  misc_feature 1..21: note = n-mer motif encoding polynucleotide
  source 1..21: mol_type = other DNA
gggcactacgctacaaacaca

SEQ ID NO: 5959 - DNA, 21 bp, synthetic construct
  misc_feature 1..21: note = n-mer motif encoding polynucleotide
  source 1..21: mol_type = other DNA
ccttcgattccgtcgttttcg

SEQ ID NO: 5960 - DNA, 21 bp, synthetic construct
  misc_feature 1..21: note = n-mer motif encoding polynucleotide
  source 1..21: mol_type = other DNA
acttatgagtatccgactcgg

SEQ ID NO: 5961 - DNA, 21 bp, synthetic construct
  misc_feature 1..21: note = n-mer motif encoding polynucleotide
  source 1..21: mol_type = other DNA
aaagaccacatcctcagcctc

SEQ ID NO: 5962 - DNA, 21 bp, synthetic construct
  misc_feature 1..21: note = n-mer motif encoding polynucleotide
  source 1..21: mol_type = other DNA
ggcacaggaggtaaccgagaa

SEQ ID NO: 5963 - DNA, 21 bp, synthetic construct
  misc_feature 1..21: note = n-mer motif encoding polynucleotide
  source 1..21: mol_type = other DNA
aagggggatggtgcttatgag

SEQ ID NO: 5964 - DNA, 21 bp, synthetic construct
  misc_feature 1..21: note = n-mer motif encoding polynucleotide
  source 1..21: mol_type = other DNA
tcttctttcggaaaagacaac

SEQ ID NO: 5965 - DNA, 21 bp, synthetic construct
  misc_feature 1..21: note = n-mer motif encoding polynucleotide
  source 1..21: mol_type = other DNA
acagtatcgtcatacgtacaa

SEQ ID NO: 5966 - DNA, 21 bp, synthetic construct
  misc_feature 1..21: note = n-mer motif encoding polynucleotide
  source 1..21: mol_type = other DNA
agggctcatggggataatcag

SEQ ID NO: 5967 - DNA, 21 bp, synthetic construct
  misc_feature 1..21: note = n-mer motif encoding polynucleotide
  source 1..21: mol_type = other DNA
tatcatgctcatagtaatgag

SEQ ID NO: 5968 - DNA, 21 bp, synthetic construct
  misc_feature 1..21: note = n-mer motif encoding polynucleotide
  source 1..21: mol_type = other DNA
gcaaacttgcccagcggtcac

SEQ ID NO: 5969 - DNA, 21 bp, synthetic construct
  misc_feature 1..21: note = n-mer motif encoding polynucleotide
  source 1..21: mol_type = other DNA
gcgaacctcaacttgaccagt

SEQ ID NO: 5970 - DNA, 21 bp, synthetic construct
  misc_feature 1..21: note = n-mer motif encoding polynucleotide
  source 1..21: mol_type = other DNA
aggcttaatgcgggtgagcat

SEQ ID NO: 5971 - DNA, 21 bp, synthetic construct
  misc_feature 1..21: note = n-mer motif encoding polynucleotide
  source 1..21: mol_type = other DNA
tatgttgattatagtaagtcg

SEQ ID NO: 5972 - DNA, 21 bp, synthetic construct
  misc_feature 1..21: note = n-mer motif encoding polynucleotide
  source 1..21: mol_type = other DNA
gctaattctgggttgcataat

SEQ ID NO: 5973 - DNA, 21 bp, synthetic construct
  misc_feature 1..21: note = n-mer motif encoding polynucleotide
  source 1..21: mol_type = other DNA
acgagtggtgtgcttacgcgg

SEQ ID NO: 5974 - DNA, 21 bp, synthetic construct
  misc_feature 1..21: note = n-mer motif encoding polynucleotide
  source 1..21: mol_type = other DNA
ggaaaaccagcacaagaattc

SEQ ID NO: 5975 - DNA, 21 bp, synthetic construct
  misc_feature 1..21: note = n-mer motif encoding polynucleotide
  source 1..21: mol_type = other DNA
gtggggacgcatttgcattcg

SEQ ID NO: 5976 - DNA, 21 bp, synthetic construct
  misc_feature 1..21: note = n-mer motif encoding polynucleotide
  source 1..21: mol_type = other DNA
ccgatgaacaaagacatactg

SEQ ID NO: 5977 - DNA, 21 bp, synthetic construct
  misc_feature 1..21: note = n-mer motif encoding polynucleotide
  source 1..21: mol_type = other DNA
gacgcccaccactcaagcagc

SEQ ID NO: 5978 - DNA, 21 bp, synthetic construct
  misc_feature 1..21: note = n-mer motif encoding polynucleotide
  source 1..21: mol_type = other DNA
actaacgccatctctcaaacg

SEQ ID NO: 5979 - DNA, 21 bp, synthetic construct
  misc_feature 1..21: note = n-mer motif encoding polynucleotide
  source 1..21: mol_type = other DNA
gttttgtctgataaggcgtat

SEQ ID NO: 5980 - DNA, 21 bp, synthetic construct
  misc_feature 1..21: note = n-mer motif encoding polynucleotide
  source 1..21: mol_type = other DNA
aacctacttgtcgaccaacgt

SEQ ID NO: 5981 - DNA, 21 bp, synthetic construct
  misc_feature 1..21: note = n-mer motif encoding polynucleotide
  source 1..21: mol_type = other DNA
actggtcatccgccggcggcg

SEQ ID NO: 5982 - DNA, 21 bp, synthetic construct
  misc_feature 1..21: note = n-mer motif encoding polynucleotide
  source 1..21: mol_type = other DNA
attagttcggggattttgtcg

SEQ ID NO: 5983 - DNA, 21 bp, synthetic construct
  misc_feature 1..21: note = n-mer motif encoding polynucleotide
  source 1..21: mol_type = other DNA
aatacgaatttgttgggttat

SEQ ID NO: 5984 - DNA, 21 bp, synthetic construct
  misc_feature 1..21: note = n-mer motif encoding polynucleotide
  source 1..21: mol_type = other DNA
acgctatcggttaccctgggt

SEQ ID NO: 5985 - DNA, 21 bp, synthetic construct
  misc_feature 1..21: note = n-mer motif encoding polynucleotide
  source 1..21: mol_type = other DNA
catactggtgttcagactaat

SEQ ID NO: 5986 - DNA, 21 bp, synthetic construct
  misc_feature 1..21: note = n-mer motif encoding polynucleotide
  source 1..21: mol_type = other DNA
gaggttagtaataataattat

SEQ ID NO: 5987 - DNA, 21 bp, synthetic construct
  misc_feature 1..21: note = n-mer motif encoding polynucleotide
  source 1..21: mol_type = other DNA
ctggctaatatttcgctgtat

SEQ ID NO: 5988 - DNA, 21 bp, synthetic construct
  misc_feature 1..21: note = n-mer motif encoding polynucleotide
  source 1..21: mol_type = other DNA
gtggagcatgttgctcatcag

SEQ ID NO: 5989 - DNA, 21 bp, synthetic construct
  misc_feature 1..21: note = n-mer motif encoding polynucleotide
  source 1..21: mol_type = other DNA
gtcgacaaaagcgaagccgac

SEQ ID NO: 5990 - DNA, 21 bp, synthetic construct
  misc_feature 1..21: note = n-mer motif encoding polynucleotide
  source 1..21: mol_type = other DNA
ggcttcgcattaactggcacc

SEQ ID NO: 5991 - DNA, 21 bp, synthetic construct
  misc_feature 1..21: note = n-mer motif encoding polynucleotide
  source 1..21: mol_type = other DNA
ttgttgacggctccgcatagg

SEQ ID NO: 5992 - DNA, 21 bp, synthetic construct
  misc_feature 1..21: note = n-mer motif encoding polynucleotide
  source 1..21: mol_type = other DNA
aatgcgggggctcttatgggt

SEQ ID NO: 5993 - DNA, 21 bp, synthetic construct
  misc_feature 1..21: note = n-mer motif encoding polynucleotide
  source 1..21: mol_type = other DNA
aggacgcaagcaggggactca

SEQ ID NO: 5994 - DNA, 21 bp, synthetic construct
  misc_feature 1..21: note = n-mer motif encoding polynucleotide
  source 1..21: mol_type = other DNA
aacacacacagacaagaatac

SEQ ID NO: 5995 - DNA, 21 bp, synthetic construct
  misc_feature 1..21: note = n-mer motif encoding polynucleotide
  source 1..21: mol_type = other DNA
aacatagcaggcggagaacaa

SEQ ID NO: 5996 - DNA, 21 bp, synthetic construct
  misc_feature 1..21: note = n-mer motif encoding polynucleotide
  source 1..21: mol_type = other DNA
gagattaataatcggactggt

SEQ ID NO: 5997 - DNA, 21 bp, synthetic construct
  misc_feature 1..21: note = n-mer motif encoding polynucleotide
  source 1..21: mol_type = other DNA
accgttaacacaatgtacacg

SEQ ID NO: 5998 - DNA, 21 bp, synthetic construct
  misc_feature 1..21: note = n-mer motif encoding polynucleotide
  source 1..21: mol_type = other DNA
cctatgaatggtattctgttg

SEQ ID NO: 5999 - DNA, 21 bp, synthetic construct
  misc_feature 1..21: note = n-mer motif encoding polynucleotide
  source 1..21: mol_type = other DNA
aatcctagttatgatcatcgg

SEQ ID NO: 6000 - DNA, 21 bp, synthetic construct
  misc_feature 1..21: note = n-mer motif encoding polynucleotide
  source 1..21: mol_type = other DNA
gctgttattctgaatcctgtt

SEQ ID NO: 6001 - DNA, 21 bp, synthetic construct
  misc_feature 1..21: note = n-mer motif encoding polynucleotide
  source 1..21: mol_type = other DNA
ctgtacgggggagcacaccaa

SEQ ID NO: 6002 - DNA, 21 bp, synthetic construct
  misc_feature 1..21: note = n-mer motif encoding polynucleotide
  source 1..21: mol_type = other DNA
caagtcaaccaaccgagaata

SEQ ID NO: 6003 - DNA, 21 bp, synthetic construct
  misc_feature 1..21: note = n-mer motif encoding polynucleotide
  source 1..21: mol_type = other DNA
gctgttagaacaccggcaatg

SEQ ID NO: 6004 - DNA, 21 bp, synthetic construct
  misc_feature 1..21: note = n-mer motif encoding polynucleotide
  source 1..21: mol_type = other DNA
agtttgacgcctaataatctt

SEQ ID NO: 6005 - DNA, 21 bp, synthetic construct
  misc_feature 1..21: note = n-mer motif encoding polynucleotide
  source 1..21: mol_type = other DNA
cttgggcaggttaattctacg

SEQ ID NO: 6006 - DNA, 21 bp, synthetic construct
  misc_feature 1..21: note = n-mer motif encoding polynucleotide
  source 1..21: mol_type = other DNA
gctaattctgctactaatcag

SEQ ID NO: 6007 - DNA, 21 bp, synthetic construct
  misc_feature 1..21: note = n-mer motif encoding polynucleotide
  source 1..21: mol_type = other DNA
tccttgacggaaaaagcgccg

SEQ ID NO: 6008 - DNA, 21 bp, synthetic construct
  misc_feature 1..21: note = n-mer motif encoding polynucleotide
  source 1..21: mol_type = other DNA
caattccacgggacatctgaa

SEQ ID NO: 6009 - DNA, 21 bp, synthetic construct
  misc_feature 1..21: note = n-mer motif encoding polynucleotide
  source 1..21: mol_type = other DNA
aaaaacggcgccataggaaca

SEQ ID NO: 6010 - DNA, 21 bp, synthetic construct
  misc_feature 1..21: note = n-mer motif encoding polynucleotide
  source 1..21: mol_type = other DNA
gtgctggcgtcgactgagaag

SEQ ID NO: 6011 - DNA, 21 bp, synthetic construct
  misc_feature 1..21: note = n-mer motif encoding polynucleotide
  source 1..21: mol_type = other DNA
agtaatatgagtgaggcgatt

SEQ ID NO: 6012 - DNA, 21 bp, synthetic construct
  misc_feature 1..21: note = n-mer motif encoding polynucleotide
  source 1..21: mol_type = other DNA
aacgctaacgccggtggaaac

SEQ ID NO: 6013 - DNA, 21 bp, synthetic construct
  misc_feature 1..21: note = n-mer motif encoding polynucleotide
  source 1..21: mol_type = other DNA
cactctaacacacactacgaa

SEQ ID NO: 6014 - DNA, 21 bp, synthetic construct
  misc_feature 1..21: note = n-mer motif encoding polynucleotide
  source 1..21: mol_type = other DNA
agtgctttgattagtgtggtt

SEQ ID NO: 6015 - DNA, 21 bp, synthetic construct
  misc_feature 1..21: note = n-mer motif encoding polynucleotide
  source 1..21: mol_type = other DNA
gtggcgactcattataatgag

SEQ ID NO: 6016 - DNA, 21 bp, synthetic construct
  misc_feature 1..21: note = n-mer motif encoding polynucleotide
  source 1..21: mol_type = other DNA
aaccaaacgttacaagtagac

SEQ ID NO: 6017 - DNA, 21 bp, synthetic construct
  misc_feature 1..21: note = n-mer motif encoding polynucleotide
  source 1..21: mol_type = other DNA
aaaacaccctcagcttcagaa

SEQ ID NO: 6018 - DNA, 21 bp, synthetic construct
  misc_feature 1..21: note = n-mer motif encoding polynucleotide
  source 1..21: mol_type = other DNA
ggtgaatcacgtacaaacatg

SEQ ID NO: 6019 - DNA, 21 bp, synthetic construct
  misc_feature 1..21: note = n-mer motif encoding polynucleotide
  source 1..21: mol_type = other DNA
cggaatgagccggttagtact

SEQ ID NO: 6020 - DNA, 21 bp, synthetic construct
  misc_feature 1..21: note = n-mer motif encoding polynucleotide
  source 1..21: mol_type = other DNA
gcaacacacgccatgcgccca

SEQ ID NO: 6021 - DNA, 21 bp, synthetic construct
  misc_feature 1..21: note = n-mer motif encoding polynucleotide
  source 1..21: mol_type = other DNA
tgggaatccctctccaacgca

SEQ ID NO: 6022 - DNA, 21 bp, synthetic construct
  misc_feature 1..21: note = n-mer motif encoding polynucleotide
  source 1..21: mol_type = other DNA
catagtcctcctacgactatg

SEQ ID NO: 6023 - DNA, 21 bp, synthetic construct
  misc_feature 1..21: note = n-mer motif encoding polynucleotide
  source 1..21: mol_type = other DNA
tctaccatgaacacgatcacg

SEQ ID NO: 6024 - DNA, 21 bp, synthetic construct
  misc_feature 1..21: note = n-mer motif encoding polynucleotide
  source 1..21: mol_type = other DNA
aacatggaacacaccatggcg

SEQ ID NO: 6025 - DNA, 21 bp, synthetic construct
  misc_feature 1..21: note = n-mer motif encoding polynucleotide
  source 1..21: mol_type = other DNA
cataatacggagtctaagact

SEQ ID NO: 6026 - DNA, 21 bp, synthetic construct
  misc_feature 1..21: note = n-mer motif encoding polynucleotide
  source 1..21: mol_type = other DNA
cacaacttaatgacccaaata

SEQ ID NO: 6027 - DNA, 21 bp, synthetic construct
  misc_feature 1..21: note = n-mer motif encoding polynucleotide
  source 1..21: mol_type = other DNA
aaccaaaacacctacgaactg

SEQ ID NO: 6028 - DNA, 21 bp, synthetic construct
  misc_feature 1..21: note = n-mer motif encoding polynucleotide
  source 1..21: mol_type = other DNA
tacgccactctcgacaccatc

SEQ ID NO: 6029 - DNA, 21 bp, synthetic construct
  misc_feature 1..21: note = n-mer motif encoding polynucleotide
  source 1..21: mol_type = other DNA
gttcagttggagaatgcgaat

SEQ ID NO: 6030 - DNA, 21 bp, synthetic construct
  misc_feature 1..21: note = n-mer motif encoding polynucleotide
  source 1..21: mol_type = other DNA
gggctcacaggatacacaatg

SEQ ID NO: 6031 - DNA, 21 bp, synthetic construct
  misc_feature 1..21: note = n-mer motif encoding polynucleotide
  source 1..21: mol_type = other DNA
ttagtacttgactcacggaac

SEQ ID NO: 6032 - DNA, 21 bp, synthetic construct
  misc_feature 1..21: note = n-mer motif encoding polynucleotide
  source 1..21: mol_type = other DNA
atgttggtacaaaacacaccc

SEQ ID NO: 6033 - DNA, 21 bp, synthetic construct
  misc_feature 1..21: note = n-mer motif encoding polynucleotide
  source 1..21: mol_type = other DNA
cctcataatcaggagatgggt

SEQ ID NO: 6034 - DNA, 21 bp, synthetic construct
  misc_feature 1..21: note = n-mer motif encoding polynucleotide
  source 1..21: mol_type = other DNA
tcgttgggggatgcgatgttg

SEQ ID NO: 6035 - DNA, 21 bp, synthetic construct
  misc_feature 1..21: note = n-mer motif encoding polynucleotide
  source 1..21: mol_type = other DNA
cgcgccgaagggagctctggc

SEQ ID NO: 6036 - DNA, 21 bp, synthetic construct
  misc_feature 1..21: note = n-mer motif encoding polynucleotide
  source 1..21: mol_type = other DNA
agtgaggagaggacgcgtgcg

SEQ ID NO: 6037 - DNA, 21 bp, synthetic construct
  misc_feature 1..21: note = n-mer motif encoding polynucleotide
  source 1..21: mol_type = other DNA
tctagtaaggagcgtacatcg

SEQ ID NO: 6038 - DNA, 21 bp, synthetic construct
  misc_feature 1..21: note = n-mer motif encoding polynucleotide
  source 1..21: mol_type = other DNA
cctgttgtgagggatcgttct

SEQ ID NO: 6039 - DNA, 21 bp, synthetic construct
  misc_feature 1..21: note = n-mer motif encoding polynucleotide
  source 1..21: mol_type = other DNA
aggatgtctgagagttcggat

SEQ ID NO: 6040 - DNA, 21 bp, synthetic construct
  misc_feature 1..21: note = n-mer motif encoding polynucleotide
  source 1..21: mol_type = other DNA
aaccaatctataagcatggac

SEQ ID NO: 6041 - DNA, 21 bp, synthetic construct
  misc_feature 1..21: note = n-mer motif encoding polynucleotide
  source 1..21: mol_type = other DNA
gtcgctgtatcgaacactcca

SEQ ID NO: 6042 - DNA, 21 bp, synthetic construct
  misc_feature 1..21: note = n-mer motif encoding polynucleotide
  source 1..21: mol_type = other DNA
ggagacatctcaagcagaaac

SEQ ID NO: 6043 - DNA, 21 bp, synthetic construct
  misc_feature 1..21: note = n-mer motif encoding polynucleotide
  source 1..21: mol_type = other DNA
gctgccggagccgactctcca

SEQ ID NO: 6044 - DNA, 21 bp, synthetic construct
  misc_feature 1..21: note = n-mer motif encoding polynucleotide
  source 1..21: mol_type = other DNA
ttcggcacatcgtacacaacc

SEQ ID NO: 6045 - DNA, 21 bp, synthetic construct
  misc_feature 1..21: note = n-mer motif encoding polynucleotide
  source 1..21: mol_type = other DNA
cgtgatactaatacggataag

SEQ ID NO: 6046 - DNA, 21 bp, synthetic construct
  misc_feature 1..21: note = n-mer motif encoding polynucleotide
  source 1..21: mol_type = other DNA
gggtctacgccgggggcgagt

SEQ ID NO: 6047 - DNA, 21 bp, synthetic construct
  misc_feature 1..21: note = n-mer motif encoding polynucleotide
  source 1..21: mol_type = other DNA
ggtactaatcatgatttttcg

SEQ ID NO: 6048 - DNA, 21 bp, synthetic construct
  misc_feature 1..21: note = n-mer motif encoding polynucleotide
  source 1..21: mol_type = other DNA
aatgagagtacgaaggagagt

SEQ ID NO: 6049 - DNA, 21 bp, synthetic construct
  misc_feature 1..21: note = n-mer motif encoding polynucleotide
  source 1..21: mol_type = other DNA
gtgcatgtgactaatgtgttg

SEQ ID NO: 6050 - DNA, 21 bp, synthetic construct
  misc_feature 1..21: note = n-mer motif encoding polynucleotide
  source 1..21: mol_type = other DNA
agtactactaatgttgcgtat

SEQ ID NO: 6051 - DNA, 21 bp, synthetic construct
  misc_feature 1..21: note = n-mer motif encoding polynucleotide
  source 1..21: mol_type = other DNA
attacgtcgttgaatgggatg

SEQ ID NO: 6052 - DNA, 21 bp, synthetic construct
  misc_feature 1..21: note = n-mer motif encoding polynucleotide
  source 1..21: mol_type = other DNA
gaagtacggggcagcgtgcca

SEQ ID NO: 6053 - DNA, 21 bp, synthetic construct
  misc_feature 1..21: note = n-mer motif encoding polynucleotide
  source 1..21: mol_type = other DNA
gcacttacccgtatgcctaac

SEQ ID NO: 6054 - DNA, 21 bp, synthetic construct
  misc_feature 1..21: note = n-mer motif encoding polynucleotide
  source 1..21: mol_type = other DNA
ctcagtgtagccgacaggcca

SEQ ID NO: 6055 - DNA, 21 bp, synthetic construct
  misc_feature 1..21: note = n-mer motif encoding polynucleotide
  source 1..21: mol_type = other DNA
gtttctacggcgcagaggcag

SEQ ID NO: 6056 - DNA, 21 bp, synthetic construct
  misc_feature 1..21: note = n-mer motif encoding polynucleotide
  source 1..21: mol_type = other DNA
ttaaacgcagaatacaccaac

SEQ ID NO: 6057 - DNA, 21 bp, synthetic construct
  misc_feature 1..21: note = n-mer motif encoding polynucleotide
  source 1..21: mol_type = other DNA
aatgagaagccgcagtcgacg

SEQ ID NO: 6058 - DNA, 21 bp, synthetic construct
  misc_feature 1..21: note = n-mer motif encoding polynucleotide
  source 1..21: mol_type = other DNA
ttgaatacgctgattgataag

SEQ ID NO: 6059 - DNA, 21 bp, synthetic construct
  misc_feature 1..21: note = n-mer motif encoding polynucleotide
  source 1..21: mol_type = other DNA
gtcacacacacactgatcgaa

SEQ ID NO: 6060 - DNA, 21 bp, synthetic construct
  misc_feature 1..21: note = n-mer motif encoding polynucleotide
  source 1..21: mol_type = other DNA
gagcagaagaagactgatcat

SEQ ID NO: 6061 - DNA, 21 bp, synthetic construct
  misc_feature 1..21: note = n-mer motif encoding polynucleotide
  source 1..21: mol_type = other DNA
acatcaggcatgtacgacacg

SEQ ID NO: 6062 - DNA, 21 bp, synthetic construct
  misc_feature 1..21: note = n-mer motif encoding polynucleotide
  source 1..21: mol_type = other DNA
cctgacgcagcgcgtagcccg

SEQ ID NO: 6063 - DNA, 21 bp, synthetic construct
  misc_feature 1..21: note = n-mer motif encoding polynucleotide
  source 1..21: mol_type = other DNA
ttgacgcaggtttatcatgag

SEQ ID NO: 6064 - DNA, 21 bp, synthetic construct
  misc_feature 1..21: note = n-mer motif encoding polynucleotide
  source 1..21: mol_type = other DNA
agagaaatgagcagcctatct

SEQ ID NO: 6065 - DNA, 21 bp, synthetic construct
  misc_feature 1..21: note = n-mer motif encoding polynucleotide
  source 1..21: mol_type = other DNA
atgccttcgaaaggcgaagta

SEQ ID NO: 6066 - DNA, 21 bp, synthetic construct
  misc_feature 1..21: note = n-mer motif encoding polynucleotide
  source 1..21: mol_type = other DNA
aatgagcagaatacgccgagt

SEQ ID NO: 6067 - DNA, 21 bp, synthetic construct
  misc_feature 1..21: note = n-mer motif encoding polynucleotide
  source 1..21: mol_type = other DNA
aaaaactacgcaagcaccgac

SEQ ID NO: 6068 - DNA, 21 bp, synthetic construct
  misc_feature 1..21: note = n-mer motif encoding polynucleotide
  source 1..21: mol_type = other DNA
tgtatggatgttggtaaggcg

SEQ ID NO: 6069 - DNA, 21 bp, synthetic construct
  misc_feature 1..21: note = n-mer motif encoding polynucleotide
  source 1..21: mol_type = other DNA
gctcttcataatctgatgaat

SEQ ID NO: 6070 - DNA, 21 bp, synthetic construct
  misc_feature 1..21: note = n-mer motif encoding polynucleotide
  source 1..21: mol_type = other DNA
cctgacagagcgaacgacaaa

SEQ ID NO: 6071 - DNA, 21 bp, synthetic construct
  misc_feature 1..21: note = n-mer motif encoding polynucleotide
  source 1..21: mol_type = other DNA
attgctcatgtgtctactaat

SEQ ID NO: 6072 - DNA, 21 bp, synthetic construct
  misc_feature 1..21: note = n-mer motif encoding polynucleotide
  source 1..21: mol_type = other DNA
aacggtccgaccggatccgcc

SEQ ID NO: 6073 - DNA, 21 bp, synthetic construct
  misc_feature 1..21: note = n-mer motif encoding polynucleotide
  source 1..21: mol_type = other DNA
tctactcatcatgctgatcgt

SEQ ID NO: 6074 - DNA, 21 bp, synthetic construct
  misc_feature 1..21: note = n-mer motif encoding polynucleotide
  source 1..21: mol_type = other DNA
ggttcgcagtatgggcggcat

SEQ ID NO: 6075 - DNA, 21 bp, synthetic construct
  misc_feature 1..21: note = n-mer motif encoding polynucleotide
  source 1..21: mol_type = other DNA
accggaacggctacactccca

SEQ ID NO: 6076 - DNA, 21 bp, synthetic construct
  misc_feature 1..21: note = n-mer motif encoding polynucleotide
  source 1..21: mol_type = other DNA
aaagcccacgttgtagaaata

SEQ ID NO: 6077 - DNA, 21 bp, synthetic construct
  misc_feature 1..21: note = n-mer motif encoding polynucleotide
  source 1..21: mol_type = other DNA
acttcgcagggtaggagtcct

SEQ ID NO: 6078 - DNA, 21 bp, synthetic construct
  misc_feature 1..21: note = n-mer motif encoding polynucleotide
  source 1..21: mol_type = other DNA
ttatcctccgaatcacccagg

SEQ ID NO: 6079 - DNA, 21 bp, synthetic construct
  misc_feature 1..21: note = n-mer motif encoding polynucleotide
  source 1..21: mol_type = other DNA
accggggttcgagaaaccata

SEQ ID NO: 6080 - DNA, 21 bp, synthetic construct
  misc_feature 1..21: note = n-mer motif encoding polynucleotide
  source 1..21: mol_type = other DNA
atggatactgagctttatagg

SEQ ID NO: 6081 - DNA, 21 bp, synthetic construct
  misc_feature 1..21: note = n-mer motif encoding polynucleotide
  source 1..21: mol_type = other DNA
acacctgaagcgagcgctcgc

SEQ ID NO: 6082 - DNA, 21 bp, synthetic construct
  misc_feature 1..21: note = n-mer motif encoding polynucleotide
  source 1..21: mol_type = other DNA
cacgacttgaaccacggaaaa

SEQ ID NO: 6083 - DNA, 21 bp, synthetic construct
  misc_feature 1..21: note = n-mer motif encoding polynucleotide
  source 1..21: mol_type = other DNA
cttactggtcagaatgcgatt

SEQ ID NO: 6084 - DNA, 21 bp, synthetic construct
  misc_feature 1..21: note = n-mer motif encoding polynucleotide
  source 1..21: mol_type = other DNA
accgtcggatcgaacagtata

SEQ ID NO: 6085 - DNA, 21 bp, synthetic construct
  misc_feature 1..21: note = n-mer motif encoding polynucleotide
  source 1..21: mol_type = other DNA
catactgtgggggctatgcat

SEQ ID NO: 6086 - DNA, 21 bp, synthetic construct
  misc_feature 1..21: note = n-mer motif encoding polynucleotide
  source 1..21: mol_type = other DNA
gaacgagtcaacgggatggca

SEQ ID NO: 6087 - DNA, 21 bp, synthetic construct
  misc_feature 1..21: note = n-mer motif encoding polynucleotide
  source 1..21: mol_type = other DNA
tccgaaccccttagagttgga

SEQ ID NO: 6088 - DNA, 21 bp, synthetic construct
  misc_feature 1..21: note = n-mer motif encoding polynucleotide
  source 1..21: mol_type = other DNA
gtctctaacgtcctctacagc

SEQ ID NO: 6089 - DNA, 21 bp, synthetic construct
  misc_feature 1..21: note = n-mer motif encoding polynucleotide
  source 1..21: mol_type = other DNA
ttctcctccggaacaaccata

SEQ ID NO: 6090 - DNA, 21 bp, synthetic construct
  misc_feature 1..21: note = n-mer motif encoding polynucleotide
  source 1..21: mol_type = other DNA
acaaacctaagtcaatcggcc

SEQ ID NO: 6091 - DNA, 21 bp, synthetic construct
  misc_feature 1..21: note = n-mer motif encoding polynucleotide
  source 1..21: mol_type = other DNA
cctaatactgctagtaatttt

SEQ ID NO: 6092 - DNA, 21 bp, synthetic construct
  misc_feature 1..21: note = n-mer motif encoding polynucleotide
  source 1..21: mol_type = other DNA
tgcggcctgaactgcggtaaa

SEQ ID NO: 6093 - DNA, 21 bp, synthetic construct
  misc_feature 1..21: note = n-mer motif encoding polynucleotide
  source 1..21: mol_type = other DNA
ccgaccggaggctcaccacca

SEQ ID NO: 6094 - DNA, 21 bp, synthetic construct
  misc_feature 1..21: note = n-mer motif encoding polynucleotide
  source 1..21: mol_type = other DNA
tacctagaatccaactacacc

SEQ ID NO: 6095 - DNA, 21 bp, synthetic construct
  misc_feature 1..21: note = n-mer motif encoding polynucleotide
  source 1..21: mol_type = other DNA
acattagaaacaacccgcagc

SEQ ID NO: 6096 - DNA, 21 bp, synthetic construct
  misc_feature 1..21: note = n-mer motif encoding polynucleotide
  source 1..21: mol_type = other DNA
tccgctaacgaacacaaccac

SEQ ID NO: 6097 - DNA, 21 bp, synthetic construct
  misc_feature 1..21: note = n-mer motif encoding polynucleotide
  source 1..21: mol_type = other DNA
gcacgagtggacaccaaccaa

SEQ ID NO: 6098 - DNA, 21 bp, synthetic construct
  misc_feature 1..21: note = n-mer motif encoding polynucleotide
  source 1..21: mol_type = other DNA
aacgtggtgaaaaacaacaca

SEQ ID NO: 6099 - DNA, 21 bp, synthetic construct
  misc_feature 1..21: note = n-mer motif encoding polynucleotide
  source 1..21: mol_type = other DNA
ggttcttattctgatggtagt

SEQ ID NO: 6100 - DNA, 21 bp, synthetic construct
  misc_feature 1..21: note = n-mer motif encoding polynucleotide
  source 1..21: mol_type = other DNA
cccggtaacggacaaagtccg

SEQ ID NO: 6101 - DNA, 21 bp, synthetic construct
  misc_feature 1..21: note = n-mer motif encoding polynucleotide
  source 1..21: mol_type = other DNA
tcgggggtaaacttcggagta

SEQ ID NO: 6102 - DNA, 21 bp, synthetic construct
  misc_feature 1..21: note = n-mer motif encoding polynucleotide
  source 1..21: mol_type = other DNA
cgaatcaacgcagcaatcgac

SEQ ID NO: 6103 - DNA, 21 bp, synthetic construct
  misc_feature 1..21: note = n-mer motif encoding polynucleotide
  source 1..21: mol_type = other DNA
caagctgggaacgcgccaagg

SEQ ID NO: 6104 - DNA, 21 bp, synthetic construct
  misc_feature 1..21: note = n-mer motif encoding polynucleotide
  source 1..21: mol_type = other DNA
cagtcggggtctctggtgccg

SEQ ID NO: 6105 - DNA, 21 bp, synthetic construct
  misc_feature 1..21: note = n-mer motif encoding polynucleotide
  source 1..21: mol_type = other DNA
ttctcaacgcaagacataagc

SEQ ID NO: 6106 - DNA, 21 bp, synthetic construct
  misc_feature 1..21: note = n-mer motif encoding polynucleotide
  source 1..21: mol_type = other DNA
gtgaatccgcatcctgcgcag

SEQ ID NO: 6107 - DNA, 21 bp, synthetic construct
  misc_feature 1..21: note = n-mer motif encoding polynucleotide
  source 1..21: mol_type = other DNA
aaaggccacgcctacgaagcc

SEQ ID NO: 6108 - DNA, 21 bp, synthetic construct
  misc_feature 1..21: note = n-mer motif encoding polynucleotide
  source 1..21: mol_type = other DNA
gaagacagtatgagattctct

SEQ ID NO: 6109 - DNA, 21 bp, synthetic construct
  misc_feature 1..21: note = n-mer motif encoding polynucleotide
  source 1..21: mol_type = other DNA
ggtaggaatgagagtccggag

SEQ ID NO: 6110 - DNA, 21 bp, synthetic construct
  misc_feature 1..21: note = n-mer motif encoding polynucleotide
  source 1..21: mol_type = other DNA
tccgacggatcgaaactacta

SEQ ID NO: 6111 - DNA, 21 bp, synthetic construct
  misc_feature 1..21: note = n-mer motif encoding polynucleotide
  source 1..21: mol_type = other DNA
actctctcaggctacatgaga

SEQ ID NO: 6112 - DNA, 21 bp, synthetic construct
  misc_feature 1..21: note = n-mer motif encoding polynucleotide
  source 1..21: mol_type = other DNA
gatattcataatccgcgtacg

SEQ ID NO: 6113 - DNA, 21 bp, synthetic construct
  misc_feature 1..21: note = n-mer motif encoding polynucleotide
  source 1..21: mol_type = other DNA
tgggccaaagacgtcaacgtc

SEQ ID NO: 6114 - DNA, 21 bp, synthetic construct
  misc_feature 1..21: note = n-mer motif encoding polynucleotide
  source 1..21: mol_type = other DNA
gctgtggggcggtcggatgat

SEQ ID NO: 6115 - DNA, 21 bp, synthetic construct
  misc_feature 1..21: note = n-mer motif encoding polynucleotide
  source 1..21: mol_type = other DNA
aaagaaaaaaccacccgcgaa

SEQ ID NO: 6116 - DNA, 21 bp, synthetic construct
  misc_feature 1..21: note = n-mer motif encoding polynucleotide
  source 1..21: mol_type = other DNA
ctgctccaatcgacctacttg

SEQ ID NO: 6117 - DNA, 21 bp, synthetic construct
  misc_feature 1..21: note = n-mer motif encoding polynucleotide
  source 1..21: mol_type = other DNA
aagtctaatttggagggtaag

SEQ ID NO: 6118 - DNA, 21 bp, synthetic construct
  misc_feature 1..21: note = n-mer motif encoding polynucleotide
  source 1..21: mol_type = other DNA
acgaggacgccttttctgggg

SEQ ID NO: 6119 - DNA, 21 bp, synthetic construct
  misc_feature 1..21: note = n-mer motif encoding polynucleotide
  source 1..21: mol_type = other DNA
cagtcggatacgacttcgatt

SEQ ID NO: 6120 - DNA, 21 bp, synthetic construct
  misc_feature 1..21: note = n-mer motif encoding polynucleotide
  source 1..21: mol_type = other DNA
gcgtggtctcaagtcctgacg

SEQ ID NO: 6121 - DNA, 21 bp, synthetic construct
  misc_feature 1..21: note = n-mer motif encoding polynucleotide
  source 1..21: mol_type = other DNA
actcaagaacgaccactaatc

SEQ ID NO: 6122 - DNA, 21 bp, synthetic construct
  misc_feature 1..21: note = n-mer motif encoding polynucleotide
  source 1..21: mol_type = other DNA
gatgataagactggtcggtat

SEQ ID NO: 6123 - DNA, 21 bp, synthetic construct
  misc_feature 1..21: note = n-mer motif encoding polynucleotide
  source 1..21: mol_type = other DNA
tttccttcgcataatggggcg

SEQ ID NO: 6124 - DNA, 21 bp, synthetic construct
  misc_feature 1..21: note = n-mer motif encoding polynucleotide
  source 1..21: mol_type = other DNA
atgctgtctcaagtcttaaca

SEQ ID NO: 6125 - DNA, 21 bp, synthetic construct
  misc_feature 1..21: note = n-mer motif encoding polynucleotide
  source 1..21: mol_type = other DNA
tctgtgacgactaatctgatg

SEQ ID NO: 6126 - DNA, 21 bp, synthetic construct
  misc_feature 1..21: note = n-mer motif encoding polynucleotide
  source 1..21: mol_type = other DNA
gaacacaactcaaaaacttac

SEQ ID NO: 6127 - DNA, 21 bp, synthetic construct
  misc_feature 1..21: note = n-mer motif encoding polynucleotide
  source 1..21: mol_type = other DNA
tatgcgcatcctgtgactcat

SEQ ID NO: 6128 - DNA, 21 bp, synthetic construct
  misc_feature 1..21: note = n-mer motif encoding polynucleotide
  source 1..21: mol_type = other DNA
cctaatccgtctccgaggcag

SEQ ID NO: 6129 - DNA, 21 bp, synthetic construct
  misc_feature 1..21: note = n-mer motif encoding polynucleotide
  source 1..21: mol_type = other DNA
catatgggtttgaatgagctt

SEQ ID NO: 6130 - DNA, 21 bp, synthetic construct
  misc_feature 1..21: note = n-mer motif encoding polynucleotide
  source 1..21: mol_type = other DNA
aacagtttgcaagcaagtgca

SEQ ID NO: 6131 - DNA, 21 bp, synthetic construct
  misc_feature 1..21: note = n-mer motif encoding polynucleotide
  source 1..21: mol_type = other DNA
gacctcggtacggctagaacc

SEQ ID NO: 6132 - DNA, 21 bp, synthetic construct
  misc_feature 1..21: note = n-mer motif encoding polynucleotide
  source 1..21: mol_type = other DNA
tacgacagccgactctacgcg

SEQ ID NO: 6133 - DNA, 21 bp, synthetic construct
  misc_feature 1..21: note = n-mer motif encoding polynucleotide
  source 1..21: mol_type = other DNA
ccgaagcctgggacgggggag

SEQ ID NO: 6134 - DNA, 21 bp, synthetic construct
  misc_feature 1..21: note = n-mer motif encoding polynucleotide
  source 1..21: mol_type = other DNA
agtctgaatggggtgttggtt

SEQ ID NO: 6135 - DNA, 21 bp, synthetic construct
  misc_feature 1..21: note = n-mer motif encoding polynucleotide
  source 1..21: mol_type = other DNA
cagtctaatttggttattaat

SEQ ID NO: 6136 - DNA, 21 bp, synthetic construct
  misc_feature 1..21: note = n-mer motif encoding polynucleotide
  source 1..21: mol_type = other DNA
gcgtctccggcgcagaccggc

SEQ ID NO: 6137 - DNA, 21 bp, synthetic construct
  misc_feature 1..21: note = n-mer motif encoding polynucleotide
  source 1..21: mol_type = other DNA
aacatgaccaacgaaaacgga

SEQ ID NO: 6138 - DNA, 21 bp, synthetic construct
  misc_feature 1..21: note = n-mer motif encoding polynucleotide
  source 1..21: mol_type = other DNA
tcacttcggacggacgaattc

SEQ ID NO: 6139 - DNA, 21 bp, synthetic construct
  misc_feature 1..21: note = n-mer motif encoding polynucleotide
  source 1..21: mol_type = other DNA
atattggacaaccaccgtttc

SEQ ID NO: 6140 - DNA, 21 bp, synthetic construct
  misc_feature 1..21: note = n-mer motif encoding polynucleotide
  source 1..21: mol_type = other DNA
ttgattaatatgagtcagaat

SEQ ID NO: 6141 - DNA, 21 bp, synthetic construct
  misc_feature 1..21: note = n-mer motif encoding polynucleotide
  source 1..21: mol_type = other DNA
ccgcaagacgtccgccaaaca

SEQ ID NO: 6142 - DNA, 21 bp, synthetic construct
  misc_feature 1..21: note = n-mer motif encoding polynucleotide
  source 1..21: mol_type = other DNA
cccttcgtagcgaacgaacca

SEQ ID NO: 6143 - DNA, 21 bp, synthetic construct
  misc_feature 1..21: note = n-mer motif encoding polynucleotide
  source 1..21: mol_type = other DNA
aatattaatgatactaagaat

SEQ ID NO: 6144 - DNA, 21 bp, synthetic construct
  misc_feature 1..21: note = n-mer motif encoding polynucleotide
  source 1..21: mol_type = other DNA
aattttagtagtggtgatgtt

SEQ ID NO: 6145 - DNA, 21 bp, synthetic construct
  misc_feature 1..21: note = n-mer motif encoding polynucleotide
  source 1..21: mol_type = other DNA
gaacgaaacggactaatagaa

SEQ ID NO: 6146 - DNA, 21 bp, synthetic construct
  misc_feature 1..21: note = n-mer motif encoding polynucleotide
  source 1..21: mol_type = other DNA
aattctcatgttcctaataat

SEQ ID NO: 6147 - DNA, 21 bp, synthetic construct
  misc_feature 1..21: note = n-mer motif encoding polynucleotide
  source 1..21: mol_type = other DNA
aacacaaccggtagctcgggc

SEQ ID NO: 6148 - DNA, 21 bp, synthetic construct
  misc_feature 1..21: note = n-mer motif encoding polynucleotide
  source 1..21: mol_type = other DNA
tcaaccagaaaagaacacgac

SEQ ID NO: 6149 - DNA, 21 bp, synthetic construct
  misc_feature 1..21: note = n-mer motif encoding polynucleotide
  source 1..21: mol_type = other DNA
gctgctaatcctagtacggag

SEQ ID NO: 6150 - DNA, 21 bp, synthetic construct
  misc_feature 1..21: note = n-mer motif encoding polynucleotide
  source 1..21: mol_type = other DNA
tcgggtatgaatagtaataag

SEQ ID NO: 6151 - DNA, 21 bp, synthetic construct
  misc_feature 1..21: note = n-mer motif encoding polynucleotide
  source 1..21: mol_type = other DNA
aagacgcttgataataatgct

SEQ ID NO: 6152 - DNA, 21 bp, synthetic construct
  misc_feature 1..21: note = n-mer motif encoding polynucleotide
  source 1..21: mol_type = other DNA
accgtaaaacaaacaagtccg

SEQ ID NO: 6153 - DNA, 21 bp, synthetic construct
  misc_feature 1..21: note = n-mer motif encoding polynucleotide
  source 1..21: mol_type = other DNA
atttctcaggtgtcttttaat

SEQ ID NO: 6154 - DNA, 21 bp, synthetic construct
  misc_feature 1..21: note = n-mer motif encoding polynucleotide
  source 1..21: mol_type = other DNA
ttagaagtaaacctgcaaacg

SEQ ID NO: 6155 - DNA, 21 bp, synthetic construct
  misc_feature 1..21: note = n-mer motif encoding polynucleotide
  source 1..21: mol_type = other DNA
gaaatgcaaaccaaaaacgcc

SEQ ID NO: 6156 - DNA, 21 bp, synthetic construct
  misc_feature 1..21: note = n-mer motif encoding polynucleotide
  source 1..21: mol_type = other DNA
gccgacaacagaaacgacaaa

SEQ ID NO: 6157 - DNA, 21 bp, synthetic construct
  misc_feature 1..21: note = n-mer motif encoding polynucleotide
  source 1..21: mol_type = other DNA
gcgtatgatacgctgaatagt

SEQ ID NO: 6158 - DNA, 21 bp, synthetic construct
  misc_feature 1..21: note = n-mer motif encoding polynucleotide
  source 1..21: mol_type = other DNA
acgattcaggatcatattaag

SEQ ID NO: 6159 - DNA, 21 bp, synthetic construct
  misc_feature 1..21: note = n-mer motif encoding polynucleotide
  source 1..21: mol_type = other DNA
gaccccactaaagttggatcc

SEQ ID NO: 6160 - DNA, 21 bp, synthetic construct
  misc_feature 1..21: note = n-mer motif encoding polynucleotide
  source 1..21: mol_type = other DNA
tccctccaacgaacccccgac

SEQ ID NO: 6161 - DNA, 21 bp, synthetic construct
  misc_feature 1..21: note = n-mer motif encoding polynucleotide
  source 1..21: mol_type = other DNA
gcaaacgactctgccaaaaca

SEQ ID NO: 6162 - DNA, 21 bp, synthetic construct
  misc_feature 1..21: note = n-mer motif encoding polynucleotide
  source 1..21: mol_type = other DNA
aaaaaagtcgaacaagaacca

SEQ ID NO: 6163 - DNA, 21 bp, synthetic construct
  misc_feature 1..21: note = n-mer motif encoding polynucleotide
  source 1..21: mol_type = other DNA
gcaagtcgggacctgggacaa

SEQ ID NO: 6164 - DNA, 21 bp, synthetic construct
  misc_feature 1..21: note = n-mer motif encoding polynucleotide
  source 1..21: mol_type = other DNA
tgggagagtgataagtttcgt

SEQ ID NO: 6165 - DNA, 21 bp, synthetic construct
  misc_feature 1..21: note = n-mer motif encoding polynucleotide
  source 1..21: mol_type = other DNA
aaccgcggaacagaagtttac

SEQ ID NO: 6166 - DNA, 21 bp, synthetic construct
  misc_feature 1..21: note = n-mer motif encoding polynucleotide
  source 1..21: mol_type = other DNA
aatattagtagtattaatcag

SEQ ID NO: 6167 - DNA, 21 bp, synthetic construct
  misc_feature 1..21: note = n-mer motif encoding polynucleotide
  source 1..21: mol_type = other DNA
gcctcgaaaggcttcggccac

SEQ ID NO: 6168 - DNA, 21 bp, synthetic construct
  misc_feature 1..21: note = n-mer motif encoding polynucleotide
  source 1..21: mol_type = other DNA
cagtcgcagaatgtgactcag

SEQ ID NO: 6169 - DNA, 21 bp, synthetic construct
  misc_feature 1..21: note = n-mer motif encoding polynucleotide
  source 1..21: mol_type = other DNA
aacggataccaactacaaatc

SEQ ID NO: 6170 - DNA, 21 bp, synthetic construct
  misc_feature 1..21: note = n-mer motif encoding polynucleotide
  source 1..21: mol_type = other DNA
tgtactaatgcgtcggatctt

SEQ ID NO: 6171 - DNA, 21 bp, synthetic construct
  misc_feature 1..21: note = n-mer motif encoding polynucleotide
  source 1..21: mol_type = other DNA
accgtcgcctcgcccaacacc

SEQ ID NO: 6172 - DNA, 21 bp, synthetic construct
  misc_feature 1..21: note = n-mer motif encoding polynucleotide
  source 1..21: mol_type = other DNA
aatactgctccgccgaatcat

SEQ ID NO: 6173 - DNA, 21 bp, synthetic construct
  misc_feature 1..21: note = n-mer motif encoding polynucleotide
  source 1..21: mol_type = other DNA
ctttctcaacaacgcgactac

SEQ ID NO: 6174 - DNA, 21 bp, synthetic construct
  misc_feature 1..21: note = n-mer motif encoding polynucleotide
  source 1..21: mol_type = other DNA
tggaatcagaatgtgtctcat

SEQ ID NO: 6175 - DNA, 21 bp, synthetic construct
  misc_feature 1..21: note = n-mer motif encoding polynucleotide
  source 1..21: mol_type = other DNA
acaggtagttcagacagatta

SEQ ID NO: 6176 - DNA, 21 bp, synthetic construct
  misc_feature 1..21: note = n-mer motif encoding polynucleotide
  source 1..21: mol_type = other DNA
aacacaacgccacctaaccac

SEQ ID NO: 6177 - DNA, 21 bp, synthetic construct
  misc_feature 1..21: note = n-mer motif encoding polynucleotide
  source 1..21: mol_type = other DNA
gtggtcgactcaacatacccg

SEQ ID NO: 6178 - DNA, 21 bp, synthetic construct
  misc_feature 1..21: note = n-mer motif encoding polynucleotide
  source 1..21: mol_type = other DNA
acggatgctacggggaggcat

SEQ ID NO: 6179 - DNA, 21 bp, synthetic construct
  misc_feature 1..21: note = n-mer motif encoding polynucleotide
  source 1..21: mol_type = other DNA
ttgtttactgctgggagtact

SEQ ID NO: 6180 - DNA, 21 bp, synthetic construct
  misc_feature 1..21: note = n-mer motif encoding polynucleotide
  source 1..21: mol_type = other DNA
ttgcgtgatcagactagtatg

SEQ ID NO: 6181 - DNA, 21 bp, synthetic construct
  misc_feature 1..21: note = n-mer motif encoding polynucleotide
  source 1..21: mol_type = other DNA
atcgaaacggaccgccaccgg

SEQ ID NO: 6182 - DNA, 21 bp, synthetic construct
  misc_feature 1..21: note = n-mer motif encoding polynucleotide
  source 1..21: mol_type = other DNA
agtgggcctgagaatacgttg

SEQ ID NO: 6183 - DNA, 21 bp, synthetic construct
  misc_feature 1..21: note = n-mer motif encoding polynucleotide
  source 1..21: mol_type = other DNA
gacaaccaaaacgccgacagg

SEQ ID NO: 6184 - DNA, 21 bp, synthetic construct
  misc_feature 1..21: note = n-mer motif encoding polynucleotide
  source 1..21: mol_type = other DNA
catgatggttatgttcctaat

SEQ ID NO: 6185 - DNA, 21 bp, synthetic construct
  misc_feature 1..21: note = n-mer motif encoding polynucleotide
  source 1..21: mol_type = other DNA
catatgtctagttattcgtcg

SEQ ID NO: 6186 - DNA, 21 bp, synthetic construct
  misc_feature 1..21: note = n-mer motif encoding polynucleotide
  source 1..21: mol_type = other DNA
agtcgtctgcagactcagcag

SEQ ID NO: 6187 - DNA, 21 bp, synthetic construct
  misc_feature 1..21: note = n-mer motif encoding polynucleotide
  source 1..21: mol_type = other DNA
tcatacacagcaggaagaccc

SEQ ID NO: 6188 - DNA, 21 bp, synthetic construct
  misc_feature 1..21: note = n-mer motif encoding polynucleotide
  source 1..21: mol_type = other DNA
gtgcagcagaataatattaat

SEQ ID NO: 6189 - DNA, 21 bp, synthetic construct
  misc_feature 1..21: note = n-mer motif encoding polynucleotide
  source 1..21: mol_type = other DNA
gatgcgaaggctcttacgact

SEQ ID NO: 6190 - DNA, 21 bp, synthetic construct
  misc_feature 1..21: note = n-mer motif encoding polynucleotide
  source 1..21: mol_type = other DNA
aaggatgagcatcttcattat

SEQ ID NO: 6191 - DNA, 21 bp, synthetic construct
  misc_feature 1..21: note = n-mer motif encoding polynucleotide
  source 1..21: mol_type = other DNA
cacggtgaccgaacagcttta

SEQ ID NO: 6192 - DNA, 21 bp, synthetic construct
  misc_feature 1..21: note = n-mer motif encoding polynucleotide
  source 1..21: mol_type = other DNA
aattttactattacggaggcg

SEQ ID NO: 6193 - DNA, 21 bp, synthetic construct
  misc_feature 1..21: note = n-mer motif encoding polynucleotide
  source 1..21: mol_type = other DNA
gacactcacatgaacaaactg

SEQ ID NO: 6194 - DNA, 21 bp, synthetic construct
  misc_feature 1..21: note = n-mer motif encoding polynucleotide
  source 1..21: mol_type = other DNA
caaccaggagccccccaaacc

SEQ ID NO: 6195 - DNA, 21 bp, synthetic construct
  misc_feature 1..21: note = n-mer motif encoding polynucleotide
  source 1..21: mol_type = other DNA
ggggaagcacgccgagaagcc

SEQ ID NO: 6196 - DNA, 21 bp, synthetic construct
  misc_feature 1..21: note = n-mer motif encoding polynucleotide
  source 1..21: mol_type = other DNA
aagtctcttagtagtgatgat

SEQ ID NO: 6197 - DNA, 21 bp, synthetic construct
  misc_feature 1..21: note = n-mer motif encoding polynucleotide
  source 1..21: mol_type = other DNA
atgaatacgacttataatgag

SEQ ID NO: 6198 - DNA, 21 bp, synthetic construct
  misc_feature 1..21: note = n-mer motif encoding polynucleotide
  source 1..21: mol_type = other DNA
gcggccgcactagaaacaata

SEQ ID NO: 6199 - DNA, 21 bp, synthetic construct
  misc_feature 1..21: note = n-mer motif encoding polynucleotide
  source 1..21: mol_type = other DNA
aacgtcgctccctacagtagc

SEQ ID NO: 6200 - DNA, 21 bp, synthetic construct
  misc_feature 1..21: note = n-mer motif encoding polynucleotide
  source 1..21: mol_type = other DNA
tctgcgggtatggtgagtctg

SEQ ID NO: 6201 - DNA, 21 bp, synthetic construct
  misc_feature 1..21: note = n-mer motif encoding polynucleotide
  source 1..21: mol_type = other DNA
tgcgacttgtcacaatcatgc

SEQ ID NO: 6202 - DNA, 21 bp, synthetic construct
  misc_feature 1..21: note = n-mer motif encoding polynucleotide
  source 1..21: mol_type = other DNA
gttttgattacgatgagttcg

SEQ ID NO: 6203 - DNA, 21 bp, synthetic construct
  misc_feature 1..21: note = n-mer motif encoding polynucleotide
  source 1..21: mol_type = other DNA
caagttggggctctaatggtt

SEQ ID NO: 6204 - DNA, 21 bp, synthetic construct
  misc_feature 1..21: note = n-mer motif encoding polynucleotide
  source 1..21: mol_type = other DNA
caacgtacctcggaagcgcca

SEQ ID NO: 6205 - DNA, 21 bp, synthetic construct
  misc_feature 1..21: note = n-mer motif encoding polynucleotide
  source 1..21: mol_type = other DNA
ttgggtaatggtagttctttg

SEQ ID NO: 6206 - DNA, 21 bp, synthetic construct
  misc_feature 1..21: note = n-mer motif encoding polynucleotide
  source 1..21: mol_type = other DNA
cctagtgtccgtttgccctta

SEQ ID NO: 6207 - DNA, 21 bp, synthetic construct
  misc_feature 1..21: note = n-mer motif encoding polynucleotide
  source 1..21: mol_type = other DNA
gattctgctccgagtactatt

SEQ ID NO: 6208 - DNA, 21 bp, synthetic construct
  misc_feature 1..21: note = n-mer motif encoding polynucleotide
  source 1..21: mol_type = other DNA
aattataatggggttaatgtg

SEQ ID NO: 6209 - DNA, 21 bp, synthetic construct
  misc_feature 1..21: note = n-mer motif encoding polynucleotide
  source 1..21: mol_type = other DNA
tcggctcatcagacgccgacg

SEQ ID NO: 6210 - DNA, 21 bp, synthetic construct
  misc_feature 1..21: note = n-mer motif encoding polynucleotide
  source 1..21: mol_type = other DNA
gatcatagtaagcagatttcg

SEQ ID NO: 6211 - DNA, 21 bp, synthetic construct
  misc_feature 1..21: note = n-mer motif encoding polynucleotide
  source 1..21: mol_type = other DNA
gccgccagcttgtcgcaaagc

SEQ ID NO: 6212 - DNA, 21 bp, synthetic construct
  misc_feature 1..21: note = n-mer motif encoding polynucleotide
  source 1..21: mol_type = other DNA
cacgccgacgttggcatgagc

SEQ ID NO: 6213 - DNA, 21 bp, synthetic construct
  misc_feature 1..21: note = n-mer motif encoding polynucleotide
  source 1..21: mol_type = other DNA
cacgtgacagtaacgttaaac

SEQ ID NO: 6214 - DNA, 21 bp, synthetic construct
  misc_feature 1..21: note = n-mer motif encoding polynucleotide
  source 1..21: mol_type = other DNA
aattctacgcatattaattcg

SEQ ID NO: 6215 - DNA, 21 bp, synthetic construct
  misc_feature 1..21: note = n-mer motif encoding polynucleotide
  source 1..21: mol_type = other DNA
ctggggcttgctggtcaggtt

SEQ ID NO: 6216 - DNA, 21 bp, synthetic construct
  misc_feature 1..21: note = n-mer motif encoding polynucleotide
  source 1..21: mol_type = other DNA
agcagtcaagcccacggccca

SEQ ID NO: 6217 - DNA, 21 bp, synthetic construct
  misc_feature 1..21: note = n-mer motif encoding polynucleotide
  source 1..21: mol_type = other DNA
gcttttaagtcgggtagtatt

SEQ ID NO: 6218 - DNA, 21 bp, synthetic construct
  misc_feature 1..21: note = n-mer motif encoding polynucleotide
  source 1..21: mol_type = other DNA
cactccccatcccacgactcg

SEQ ID NO: 6219 - DNA, 21 bp, synthetic construct
  misc_feature 1..21: note = n-mer motif encoding polynucleotide
  source 1..21: mol_type = other DNA
ccaaacggcgaaagttcgcga

SEQ ID NO: 6220 - DNA, 21 bp, synthetic construct
  misc_feature 1..21: note = n-mer motif encoding polynucleotide
  source 1..21: mol_type = other DNA
attcttacgcctttggataag

SEQ ID NO: 6221 - DNA, 21 bp, synthetic construct
  misc_feature 1..21: note = n-mer motif encoding polynucleotide
  source 1..21: mol_type = other DNA
tccgcctcttactccaggatg

SEQ ID NO: 6222 - DNA, 21 bp, synthetic construct
  misc_feature 1..21: note = n-mer motif encoding polynucleotide
  source 1..21: mol_type = other DNA
gaggcgttgcatgatcggaat

SEQ ID NO: 6223 - DNA, 21 bp, synthetic construct
  misc_feature 1..21: note = n-mer motif encoding polynucleotide
  source 1..21: mol_type = other DNA
ggtgaacaacacaacgccccc

SEQ ID NO: 6224 - DNA, 21 bp, synthetic construct
  misc_feature 1..21: note = n-mer motif encoding polynucleotide
  source 1..21: mol_type = other DNA
gggaatatggttacgcctaat

SEQ ID NO: 6225 - DNA, 21 bp, synthetic construct
  misc_feature 1..21: note = n-mer motif encoding polynucleotide
  source 1..21: mol_type = other DNA
aacgctctcctcaacgcacct

SEQ ID NO: 6226 - DNA, 21 bp, synthetic construct
  misc_feature 1..21: note = n-mer motif encoding polynucleotide
  source 1..21: mol_type = other DNA
gcaagtgacctacaaatgacg

SEQ ID NO: 6227 - DNA, 21 bp, synthetic construct
  misc_feature 1..21: note = n-mer motif encoding polynucleotide
  source 1..21: mol_type = other DNA
tcgtatgatatgcatacgaat

SEQ ID NO: 6228 - DNA, 21 bp, synthetic construct
  misc_feature 1..21: note = n-mer motif encoding polynucleotide
  source 1..21: mol_type = other DNA
aatatgtcgcatagtactctg

SEQ ID NO: 6229 - DNA, 21 bp, synthetic construct
  misc_feature 1..21: note = n-mer motif encoding polynucleotide
  source 1..21: mol_type = other DNA
actgccaacaaccactctccg

SEQ ID NO: 6230 - DNA, 21 bp, synthetic construct
  misc_feature 1..21: note = n-mer motif encoding polynucleotide
  source 1..21: mol_type = other DNA
caagccccgccaacagcacaa

SEQ ID NO: 6231 - DNA, 21 bp, synthetic construct
  misc_feature 1..21: note = n-mer motif encoding polynucleotide
  source 1..21: mol_type = other DNA
aactaccacggagacaacgtt

SEQ ID NO: 6232 - DNA, 21 bp, synthetic construct
  misc_feature 1..21: note = n-mer motif encoding polynucleotide
  source 1..21: mol_type = other DNA
agggatagtactattagtcgg

SEQ ID NO: 6233 - DNA, 21 bp, synthetic construct
  misc_feature 1..21: note = n-mer motif encoding polynucleotide
  source 1..21: mol_type = other DNA
gtttcttcgcctaatggtacg

SEQ ID NO: 6234 - DNA, 21 bp, synthetic construct
  misc_feature 1..21: note = n-mer motif encoding polynucleotide
  source 1..21: mol_type = other DNA
tcccgaatcacggtgaacgca

SEQ ID NO: 6235 - DNA, 21 bp, synthetic construct
  misc_feature 1..21: note = n-mer motif encoding polynucleotide
  source 1..21: mol_type = other DNA
gtcggaacaacctcgaacggc

SEQ ID NO: 6236 - DNA, 21 bp, synthetic construct
  misc_feature 1..21: note = n-mer motif encoding polynucleotide
  source 1..21: mol_type = other DNA
catacgaatcagatgcagcct

SEQ ID NO: 6237 - DNA, 21 bp, synthetic construct
  misc_feature 1..21: note = n-mer motif encoding polynucleotide
  source 1..21: mol_type = other DNA
aaaagcaacgcgggattcggt

SEQ ID NO: 6238 - DNA, 21 bp, synthetic construct
  misc_feature 1..21: note = n-mer motif encoding polynucleotide
  source 1..21: mol_type = other DNA
aaagaaagcctcgaagacgtc

SEQ ID NO: 6239 - DNA, 21 bp, synthetic construct
  misc_feature 1..21: note = n-mer motif encoding polynucleotide
  source 1..21: mol_type = other DNA
gcgcaggttaataatcatgat

SEQ ID NO: 6240 - DNA, 21 bp, synthetic construct
  misc_feature 1..21: note = n-mer motif encoding polynucleotide
  source 1..21: mol_type = other DNA
aacgcttctacctacatggac

SEQ ID NO: 6241 - DNA, 21 bp, synthetic construct
  misc_feature 1..21: note = n-mer motif encoding polynucleotide
  source 1..21: mol_type = other DNA
acgtctgatacgaatgctagg

SEQ ID NO: 6242 - DNA, 21 bp, synthetic construct
  misc_feature 1..21: note = n-mer motif encoding polynucleotide
  source 1..21: mol_type = other DNA
gagagtcgtatgcgtagtatt

SEQ ID NO: 6243 - DNA, 21 bp, synthetic construct
  misc_feature 1..21: note = n-mer motif encoding polynucleotide
  source 1..21: mol_type = other DNA
cgtgttgaagacaccaactcc

SEQ ID NO: 6244 - DNA, 21 bp, synthetic construct
  misc_feature 1..21: note = n-mer motif encoding polynucleotide
  source 1..21: mol_type = other DNA
gcctctaaccacctacaagcc

SEQ ID NO: 6245 - DNA, 21 bp, synthetic construct
  misc_feature 1..21: note = n-mer motif encoding polynucleotide
  source 1..21: mol_type = other DNA
cgcttacacggctcagactcg

SEQ ID NO: 6246 - DNA, 21 bp, synthetic construct
  misc_feature 1..21: note = n-mer motif encoding polynucleotide
  source 1..21: mol_type = other DNA
accgtcgaacaaataaactcg

SEQ ID NO: 6247 - DNA, 21 bp, synthetic construct
  misc_feature 1..21: note = n-mer motif encoding polynucleotide
  source 1..21: mol_type = other DNA
aggtccgtaccatcaccacac

SEQ ID NO: 6248 - DNA, 21 bp, synthetic construct
  misc_feature 1..21: note = n-mer motif encoding polynucleotide
  source 1..21: mol_type = other DNA
gaatacctcgccctgggacac

SEQ ID NO: 6249 - DNA, 21 bp, synthetic construct
  misc_feature 1..21: note = n-mer motif encoding polynucleotide
  source 1..21: mol_type = other DNA
aatactaataatcaggagcag

SEQ ID NO: 6250 - DNA, 21 bp, synthetic construct
  misc_feature 1..21: note = n-mer motif encoding polynucleotide
  source 1..21: mol_type = other DNA
aactacggttccggacgaatc

SEQ ID NO: 6251 - DNA, 21 bp, synthetic construct
  misc_feature 1..21: note = n-mer motif encoding polynucleotide
  source 1..21: mol_type = other DNA
cgccacggggacacaccgatg

SEQ ID NO: 6252 - DNA, 21 bp, synthetic construct
  misc_feature 1..21: note = n-mer motif encoding polynucleotide
  source 1..21: mol_type = other DNA
aacgacaccatcggcagacca

SEQ ID NO: 6253 - DNA, 21 bp, synthetic construct
  misc_feature 1..21: note = n-mer motif encoding polynucleotide
  source 1..21: mol_type = other DNA
tatggggagcgtgctaggacg

SEQ ID NO: 6254 - DNA, 21 bp, synthetic construct
  misc_feature 1..21: note = n-mer motif encoding polynucleotide
  source 1..21: mol_type = other DNA
gttcttgggatgcagaggtct

SEQ ID NO: 6255 - DNA, 21 bp, synthetic construct
  misc_feature 1..21: note = n-mer motif encoding polynucleotide
  source 1..21: mol_type = other DNA
cttcattttcatgcttcgcag

SEQ ID NO: 6256 - DNA, 21 bp, synthetic construct
  misc_feature 1..21: note = n-mer motif encoding polynucleotide
  source 1..21: mol_type = other DNA
accgacacgctcagcgaaaga

SEQ ID NO: 6257 - DNA, 21 bp, synthetic construct
  misc_feature 1..21: note = n-mer motif encoding polynucleotide
  source 1..21: mol_type = other DNA
gggacaggtaccgttggatgg

SEQ ID NO: 6258 - DNA, 21 bp, synthetic construct
  misc_feature 1..21: note = n-mer motif encoding polynucleotide
  source 1..21: mol_type = other DNA
acagaaagccccaaactacta

SEQ ID NO: 6259 - DNA, 21 bp, synthetic construct
  misc_feature 1..21: note = n-mer motif encoding polynucleotide
  source 1..21: mol_type = other DNA
acgattaggagtgagggtttt

SEQ ID NO: 6260 - DNA, 21 bp, synthetic construct
  misc_feature 1..21: note = n-mer motif encoding polynucleotide
  source 1..21: mol_type = other DNA
gcgtctagttatattaataat

SEQ ID NO: 6261 - DNA, 21 bp, synthetic construct
  misc_feature 1..21: note = n-mer motif encoding polynucleotide
  source 1..21: mol_type = other DNA
ttacaccttgggttatcatct

SEQ ID NO: 6262 - DNA, 21 bp, synthetic construct
  misc_feature 1..21: note = n-mer motif encoding polynucleotide
  source 1..21: mol_type = other DNA
gtcactggcactaccccggga

SEQ ID NO: 6263 - DNA, 21 bp, synthetic construct
  misc_feature 1..21: note = n-mer motif encoding polynucleotide
  source 1..21: mol_type = other DNA
gtgacgtcgtctgctagtggt

SEQ ID NO: 6264 - DNA, 21 bp, synthetic construct
  misc_feature 1..21: note = n-mer motif encoding polynucleotide
  source 1..21: mol_type = other DNA
caaatgcacctacacatgcaa

SEQ ID NO: 6265 - DNA, 21 bp, synthetic construct
  misc_feature 1..21: note = n-mer motif encoding polynucleotide
  source 1..21: mol_type = other DNA
ggtaccatgagtctattaatg

SEQ ID NO: 6266 - DNA, 21 bp, synthetic construct
  misc_feature 1..21: note = n-mer motif encoding polynucleotide
  source 1..21: mol_type = other DNA
tgcgcatcagaagtttgccaa

SEQ ID NO: 6267 - DNA, 21 bp, synthetic construct
  misc_feature 1..21: note = n-mer motif encoding polynucleotide
  source 1..21: mol_type = other DNA
aatcttgtgatgagtgggacg

SEQ ID NO: 6268 - DNA, 21 bp, synthetic construct
  misc_feature 1..21: note = n-mer motif encoding polynucleotide
  source 1..21: mol_type = other DNA
caatcactcaaagacggcact

SEQ ID NO: 6269 - DNA, 21 bp, synthetic construct
  misc_feature 1..21: note = n-mer motif encoding polynucleotide
  source 1..21: mol_type = other DNA
gcgttgaatggttctggtatt

SEQ ID NO: 6270 - DNA, 21 bp, synthetic construct
  misc_feature 1..21: note = n-mer motif encoding polynucleotide
  source 1..21: mol_type = other DNA
agacacgtcgtccccgactcc

SEQ ID NO: 6271 - DNA, 21 bp, synthetic construct
  misc_feature 1..21: note = n-mer motif encoding polynucleotide
  source 1..21: mol_type = other DNA
ctgtatcatgattcgcatctt

SEQ ID NO: 6272 - DNA, 21 bp, synthetic construct
  misc_feature 1..21: note = n-mer motif encoding polynucleotide
  source 1..21: mol_type = other DNA
gggagtacgcctattacttct

SEQ ID NO: 6273 - DNA, 21 bp, synthetic construct
  misc_feature 1..21: note = n-mer motif encoding polynucleotide
  source 1..21: mol_type = other DNA
cccaacgaccaaatcagcgga

SEQ ID NO: 6274 - DNA, 21 bp, synthetic construct
  misc_feature 1..21: note = n-mer motif encoding polynucleotide
  source 1..21: mol_type = other DNA
agtggaaaacaagacaaatac

SEQ ID NO: 6275 - DNA, 21 bp, synthetic construct
  misc_feature 1..21: note = n-mer motif encoding polynucleotide
  source 1..21: mol_type = other DNA
agtgggcatgcttctcagggt

SEQ ID NO: 6276 - DNA, 21 bp, synthetic construct
  misc_feature 1..21: note = n-mer motif encoding polynucleotide
  source 1..21: mol_type = other DNA
aagatggggagtattgaggtt

SEQ ID NO: 6277 - DNA, 21 bp, synthetic construct
  misc_feature 1..21: note = n-mer motif encoding polynucleotide
  source 1..21: mol_type = other DNA
tcaactttagaccgaagcgaa

SEQ ID NO: 6278 - DNA, 21 bp, synthetic construct
  misc_feature 1..21: note = n-mer motif encoding polynucleotide
  source 1..21: mol_type = other DNA
acggagcttagtgagtatact

SEQ ID NO: 6279 - DNA, 21 bp, synthetic construct
  misc_feature 1..21: note = n-mer motif encoding polynucleotide
  source 1..21: mol_type = other DNA
gccaacggaggaggatacccc

SEQ ID NO: 6280 - DNA, 21 bp, synthetic construct
  misc_feature 1..21: note = n-mer motif encoding polynucleotide
  source 1..21: mol_type = other DNA
gtaaccgaatctaactctcta

SEQ ID NO: 6281 - DNA, 21 bp, synthetic construct
  misc_feature 1..21: note = n-mer motif encoding polynucleotide
  source 1..21: mol_type = other DNA
ccagtctacgaccgcgacgtc

SEQ ID NO: 6282 - DNA, 21 bp, synthetic construct
  misc_feature 1..21: note = n-mer motif encoding polynucleotide
  source 1..21: mol_type = other DNA
gataataataagcatggtact

SEQ ID NO: 6283 - DNA, 21 bp, synthetic construct
  misc_feature 1..21: note = n-mer motif encoding polynucleotide
  source 1..21: mol_type = other DNA
atctacgaaaccgtaaccttg

SEQ ID NO: 6284 - DNA, 21 bp, synthetic construct
  misc_feature 1..21: note = n-mer motif encoding polynucleotide
  source 1..21: mol_type = other DNA
actcagactggtcatgtttct

SEQ ID NO: 6285 - DNA, 21 bp, synthetic construct
  misc_feature 1..21: note = n-mer motif encoding polynucleotide
  source 1..21: mol_type = other DNA
caagccgacctcaggtacaaa

SEQ ID NO: 6286 - DNA, 21 bp, synthetic construct
  misc_feature 1..21: note = n-mer motif encoding polynucleotide
  source 1..21: mol_type = other DNA
tgtaagacgaataatgctggt

SEQ ID NO: 6287 - DNA, 21 bp, synthetic construct
  misc_feature 1..21: note = n-mer motif encoding polynucleotide
  source 1..21: mol_type = other DNA
gccggtcaccaacaactggcc

SEQ ID NO: 6288 - DNA, 21 bp, synthetic construct
  misc_feature 1..21: note = n-mer motif encoding polynucleotide
  source 1..21: mol_type = other DNA
gatagggatatggagggtgtt

SEQ ID NO: 6289 - DNA, 21 bp, synthetic construct
  misc_feature 1..21: note = n-mer motif encoding polynucleotide
  source 1..21: mol_type = other DNA
gatcagccggggtatgtgcgt

SEQ ID NO: 6290 - DNA, 21 bp, synthetic construct
  misc_feature 1..21: note = n-mer motif encoding polynucleotide
  source 1..21: mol_type = other DNA
gatgctatgcttgctcatccg

SEQ ID NO: 6291 - DNA, 21 bp, synthetic construct
  misc_feature 1..21: note = n-mer motif encoding polynucleotide
  source 1..21: mol_type = other DNA
gcccttaacctgtactccagc

SEQ ID NO: 6292 - DNA, 21 bp, synthetic construct
  misc_feature 1..21: note = n-mer motif encoding polynucleotide
  source 1..21: mol_type = other DNA
ctactatctaaaggggactcc

SEQ ID NO: 6293 - DNA, 21 bp, synthetic construct
  misc_feature 1..21: note = n-mer motif encoding polynucleotide
  source 1..21: mol_type = other DNA
tcgagtattagtctgcggtat

SEQ ID NO: 6294 - DNA, 21 bp, synthetic construct
  misc_feature 1..21: note = n-mer motif encoding polynucleotide
  source 1..21: mol_type = other DNA
gggtcgagccaacaccacgaa

SEQ ID NO: 6295 - DNA, 21 bp, synthetic construct
  misc_feature 1..21: note = n-mer motif encoding polynucleotide
  source 1..21: mol_type = other DNA
tcgattgggtattcgcctccg

SEQ ID NO: 6296 - DNA, 21 bp, synthetic construct
  misc_feature 1..21: note = n-mer motif encoding polynucleotide
  source 1..21: mol_type = other DNA
cactccaacgcgactacgata

SEQ ID NO: 6297 - DNA, 21 bp, synthetic construct
  misc_feature 1..21: note = n-mer motif encoding polynucleotide
  source 1..21: mol_type = other DNA
tcggcacacgacgcaagacta

SEQ ID NO: 6298 - DNA, 21 bp, synthetic construct
  misc_feature 1..21: note = n-mer motif encoding polynucleotide
  source 1..21: mol_type = other DNA
gttcacaccgcagacacaata

SEQ ID NO: 6299 - DNA, 21 bp, synthetic construct
  misc_feature 1..21: note = n-mer motif encoding polynucleotide
  source 1..21: mol_type = other DNA
cgagacggctctactaaagtt

SEQ ID NO: 6300 - DNA, 21 bp, synthetic construct
  misc_feature 1..21: note = n-mer motif encoding polynucleotide
  source 1..21: mol_type = other DNA
ttgcaggagtctcttcctggt

SEQ ID NO: 6301 - DNA, 21 bp, synthetic construct
  misc_feature 1..21: note = n-mer motif encoding polynucleotide
  source 1..21: mol_type = other DNA
ttagactacacccctcaaaac

SEQ ID NO: 6302 - DNA, 21 bp, synthetic construct
  misc_feature 1..21: note = n-mer motif encoding polynucleotide
  source 1..21: mol_type = other DNA
ggaccaagttcgcacatcgtt

SEQ ID NO: 6303 - DNA, 21 bp, synthetic construct
  misc_feature 1..21: note = n-mer motif encoding polynucleotide
  source 1..21: mol_type = other DNA
agcgccgacacccggtccccc

SEQ ID NO: 6304 - DNA, 21 bp, synthetic construct
  misc_feature 1..21: note = n-mer motif encoding polynucleotide
  source 1..21: mol_type = other DNA
atgatgaagagtgaggagaat

SEQ ID NO: 6305 - DNA, 21 bp, synthetic construct
  misc_feature 1..21: note = n-mer motif encoding polynucleotide
  source 1..21: mol_type = other DNA
ggtatgacgagtgagttgacg

SEQ ID NO: 6306 - DNA, 21 bp, synthetic construct
  misc_feature 1..21: note = n-mer motif encoding polynucleotide
  source 1..21: mol_type = other DNA
gtagacacctacagcggtctg

SEQ ID NO: 6307 - DNA, 21 bp, synthetic construct
  misc_feature 1..21: note = n-mer motif encoding polynucleotide
  source 1..21: mol_type = other DNA
gggatgagggatacgccgccg

SEQ ID NO: 6308 - DNA, 21 bp, synthetic construct
  misc_feature 1..21: note = n-mer motif encoding polynucleotide
  source 1..21: mol_type = other DNA
gagcatgatgtgagtacgcgt

SEQ ID NO: 6309 - DNA, 21 bp, synthetic construct
  misc_feature 1..21: note = n-mer motif encoding polynucleotide
  source 1..21: mol_type = other DNA
gaggtggtgaagactactcat

SEQ ID NO: 6310 - DNA, 21 bp, synthetic construct
  misc_feature 1..21: note = n-mer motif encoding polynucleotide
  source 1..21: mol_type = other DNA
gtttacgacaacgtttcttct

SEQ ID NO: 6311 - DNA, 21 bp, synthetic construct
  misc_feature 1..21: note = n-mer motif encoding polynucleotide
  source 1..21: mol_type = other DNA
ctcatgaaagacatggaatcc

SEQ ID NO: 6312 - DNA, 21 bp, synthetic construct
  misc_feature 1..21: note = n-mer motif encoding polynucleotide
  source 1..21: mol_type = other DNA
cctcttcatgttgcttctcct

SEQ ID NO: 6313 - DNA, 21 bp, synthetic construct
  misc_feature 1..21: note = n-mer motif encoding polynucleotide
  source 1..21: mol_type = other DNA
gaagtacgcgaccaaaaaaca

SEQ ID NO: 6314 - DNA, 21 bp, synthetic construct
  misc_feature 1..21: note = n-mer motif encoding polynucleotide
  source 1..21: mol_type = other DNA
ccaactccctactacaccgcc

SEQ ID NO: 6315 - DNA, 21 bp, synthetic construct
  misc_feature 1..21: note = n-mer motif encoding polynucleotide
  source 1..21: mol_type = other DNA
aacaactacgcctactccgct

SEQ ID NO: 6316 - DNA, 21 bp, synthetic construct
  misc_feature 1..21: note = n-mer motif encoding polynucleotide
  source 1..21: mol_type = other DNA
cttgttgatacggataggaat

SEQ ID NO: 6317 - DNA, 21 bp, synthetic construct
  misc_feature 1..21: note = n-mer motif encoding polynucleotide
  source 1..21: mol_type = other DNA
tatccggctgatcatcggact

SEQ ID NO: 6318 - DNA, 21 bp, synthetic construct
  misc_feature 1..21: note = n-mer motif encoding polynucleotide
  source 1..21: mol_type = other DNA
tctgcaacaacgaaccacgga

SEQ ID NO: 6319 - DNA, 21 bp, synthetic construct
  misc_feature 1..21: note = n-mer motif encoding polynucleotide
  source 1..21: mol_type = other DNA
cgtgatgatcagcagcttgat

SEQ ID NO: 6320 - DNA, 21 bp, synthetic construct
  misc_feature 1..21: note = n-mer motif encoding polynucleotide
  source 1..21: mol_type = other DNA
ggagcgggacaatctcacgtg

SEQ ID NO: 6321 - DNA, 21 bp, synthetic construct
  misc_feature 1..21: note = n-mer motif encoding polynucleotide
  source 1..21: mol_type = other DNA
gataggacttatcatgaggtg

SEQ ID NO: 6322 - DNA, 21 bp, synthetic construct
  misc_feature 1..21: note = n-mer motif encoding polynucleotide
  source 1..21: mol_type = other DNA
gatggtaataatacgacttat

SEQ ID NO: 6323 - DNA, 21 bp, synthetic construct
  misc_feature 1..21: note = n-mer motif encoding polynucleotide
  source 1..21: mol_type = other DNA
gtgcatatggagtcgtatgcg

SEQ ID NO: 6324 - DNA, 21 bp, synthetic construct
  misc_feature 1..21: note = n-mer motif encoding polynucleotide
  source 1..21: mol_type = other DNA
tggtacgaaacaatcagcccg

SEQ ID NO: 6325 - DNA, 21 bp, synthetic construct
  misc_feature 1..21: note = n-mer motif encoding polynucleotide
  source 1..21: mol_type = other DNA
ctgttgggggctcatcagccg

SEQ ID NO: 6326 - DNA, 21 bp, synthetic construct
  misc_feature 1..21: note = n-mer motif encoding polynucleotide
  source 1..21: mol_type = other DNA
cacgtacctaacactgaagca

SEQ ID NO: 6327 - DNA, 21 bp, synthetic construct
  misc_feature 1..21: note = n-mer motif encoding polynucleotide
  source 1..21: mol_type = other DNA
aattctcagaatcctcagggt

SEQ ID NO: 6328 - DNA, 21 bp, synthetic construct
  misc_feature 1..21: note = n-mer motif encoding polynucleotide
  source 1..21: mol_type = other DNA
ctacaagaccgggcaacgaac

SEQ ID NO: 6329 - DNA, 21 bp, synthetic construct
  misc_feature 1..21: note = n-mer motif encoding polynucleotide
  source 1..21: mol_type = other DNA
attgtgaatcagcattcggag

SEQ ID NO: 6330 - DNA, 21 bp, synthetic construct
  misc_feature 1..21: note = n-mer motif encoding polynucleotide
  source 1..21: mol_type = other DNA
tttgagcagggtaaggttgag

SEQ ID NO: 6331 - DNA, 21 bp, synthetic construct
  misc_feature 1..21: note = n-mer motif encoding polynucleotide
  source 1..21: mol_type = other DNA
gtggcgacgggtgtgtttgct

SEQ ID NO: 6332 - DNA, 21 bp, synthetic construct
  misc_feature 1..21: note = n-mer motif encoding polynucleotide
  source 1..21: mol_type = other DNA
gacaaaatacaaaacgaaaca

SEQ ID NO: 6333 - DNA, 21 bp, synthetic construct
  misc_feature 1..21: note = n-mer motif encoding polynucleotide
  source 1..21: mol_type = other DNA
acggacaacccgtcctacaaa

SEQ ID NO: 6334 - DNA, 21 bp, synthetic construct
  misc_feature 1..21: note = n-mer motif encoding polynucleotide
  source 1..21: mol_type = other DNA
ggcgtgaacacaaaaatcgaa

SEQ ID NO: 6335 - DNA, 21 bp, synthetic construct
  misc_feature 1..21: note = n-mer motif encoding polynucleotide
  source 1..21: mol_type = other DNA
ggctctcacaacggcccagcc

SEQ ID NO: 6336 - DNA, 21 bp, synthetic construct
  misc_feature 1..21: note = n-mer motif encoding polynucleotide
  source 1..21: mol_type = other DNA
tccaacatgggcgtagcctct

SEQ ID NO: 6337 - DNA, 21 bp, synthetic construct
  misc_feature 1..21: note = n-mer motif encoding polynucleotide
  source 1..21: mol_type = other DNA
aacacggacactaacgaaaaa

SEQ ID NO: 6338 - DNA, 21 bp, synthetic construct
  misc_feature 1..21: note = n-mer motif encoding polynucleotide
  source 1..21: mol_type = other DNA
tctgcgcttttgcggatggat

SEQ ID NO: 6339 - DNA, 21 bp, synthetic construct
  misc_feature 1..21: note = n-mer motif encoding polynucleotide
  source 1..21: mol_type = other DNA
cctcaactaagcggcacagcg

SEQ ID NO: 6340 - DNA, 21 bp, synthetic construct
  misc_feature 1..21: note = n-mer motif encoding polynucleotide
  source 1..21: mol_type = other DNA
tctattgttaataatggggct

SEQ ID NO: 6341 - DNA, 21 bp, synthetic construct
  misc_feature 1..21: note = n-mer motif encoding polynucleotide
  source 1..21: mol_type = other DNA
agcctagaccacgcccctcta

SEQ ID NO: 6342 - DNA, 21 bp, synthetic construct
  misc_feature 1..21: note = n-mer motif encoding polynucleotide
  source 1..21: mol_type = other DNA
gaccactcgaaacaaaactct

SEQ ID NO: 6343 - DNA, 21 bp, synthetic construct
  misc_feature 1..21: note = n-mer motif encoding polynucleotide
  source 1..21: mol_type = other DNA
cacagtgacatggtcagcggc

SEQ ID NO: 6344 - DNA, 21 bp, synthetic construct
  misc_feature 1..21: note = n-mer motif encoding polynucleotide
  source 1..21: mol_type = other DNA
cagcatcgtgcgcaggatgtg

SEQ ID NO: 6345 - DNA, 21 bp, synthetic construct
  misc_feature 1..21: note = n-mer motif encoding polynucleotide
  source 1..21: mol_type = other DNA
ggtagtactaagtctgggcag

SEQ ID NO: 6346 - DNA, 21 bp, synthetic construct
  misc_feature 1..21: note = n-mer motif encoding polynucleotide
  source 1..21: mol_type = other DNA
acaatgagcgtaactctggaa

SEQ ID NO: 6347 - DNA, 21 bp, synthetic construct
  misc_feature 1..21: note = n-mer motif encoding polynucleotide
  source 1..21: mol_type = other DNA
tataataatggtgggcatgtt

SEQ ID NO: 6348 - DNA, 21 bp, synthetic construct
  misc_feature 1..21: note = n-mer motif encoding polynucleotide
  source 1..21: mol_type = other DNA
ggtactgctgagaatacgagt

SEQ ID NO: 6349 - DNA, 21 bp, synthetic construct
  misc_feature 1..21: note = n-mer motif encoding polynucleotide
  source 1..21: mol_type = other DNA
aatagttatgatgcgacgagg

SEQ ID NO: 6350 - DNA, 21 bp, synthetic construct
  misc_feature 1..21: note = n-mer motif encoding polynucleotide
  source 1..21: mol_type = other DNA
agcgtcaacaacatgcgactc

SEQ ID NO: 6351 - DNA, 21 bp, synthetic construct
  misc_feature 1..21: note = n-mer motif encoding polynucleotide
  source 1..21: mol_type = other DNA
cttaacttacaatacactctg

SEQ ID NO: 6352 - DNA, 21 bp, synthetic construct
  misc_feature 1..21: note = n-mer motif encoding polynucleotide
  source 1..21: mol_type = other DNA
gaggcgcagaccggctgggtt

SEQ ID NO: 6353 - DNA, 21 bp, synthetic construct
  misc_feature 1..21: note = n-mer motif encoding polynucleotide
  source 1..21: mol_type = other DNA
cccgctgaaggaaacaaccgt

SEQ ID NO: 6354 - DNA, 21 bp, synthetic construct
  misc_feature 1..21: note = n-mer motif encoding polynucleotide
  source 1..21: mol_type = other DNA
tctctgggtgggaatccgcct

SEQ ID NO: 6355 - DNA, 21 bp, synthetic construct
  misc_feature 1..21: note = n-mer motif encoding polynucleotide
  source 1..21: mol_type = other DNA
tataatagggataatggttct

SEQ ID NO: 6356 - DNA, 21 bp, synthetic construct
  misc_feature 1..21: note = n-mer motif encoding polynucleotide
  source 1..21: mol_type = other DNA
ttgactgatcctaaggggcag

SEQ ID NO: 6357 - DNA, 21 bp, synthetic construct
  misc_feature 1..21: note = n-mer motif encoding polynucleotide
  source 1..21: mol_type = other DNA
accccaacaggcaccaacaaa

SEQ ID NO: 6358 - DNA, 21 bp, synthetic construct
  misc_feature 1..21: note = n-mer motif encoding polynucleotide
  source 1..21: mol_type = other DNA
gttcacgctaacgctacatta

SEQ ID NO: 6359 - DNA, 21 bp, synthetic construct
  misc_feature 1..21: note = n-mer motif encoding polynucleotide
  source 1..21: mol_type = other DNA
cgcgaaatagtgcactcaaac

SEQ ID NO: 6360 - DNA, 21 bp, synthetic construct
  misc_feature 1..21: note = n-mer motif encoding polynucleotide
  source 1..21: mol_type = other DNA
tacgccgtcgcgataggcaca

SEQ ID NO: 6361 - DNA, 21 bp, synthetic construct
  misc_feature 1..21: note = n-mer motif encoding polynucleotide
  source 1..21: mol_type = other DNA
aacacaacacctcccgaccac

SEQ ID NO: 6362 - DNA, 21 bp, synthetic construct
  misc_feature 1..21: note = n-mer motif encoding polynucleotide
  source 1..21: mol_type = other DNA
gttattcagtctgataatacg

SEQ ID NO: 6363 - DNA, 21 bp, synthetic construct
  misc_feature 1..21: note = n-mer motif encoding polynucleotide
  source 1..21: mol_type = other DNA
gttccggcgcattctcggggt

SEQ ID NO: 6364 - DNA, 21 bp, synthetic construct
  misc_feature 1..21: note = n-mer motif encoding polynucleotide
  source 1..21: mol_type = other DNA
caaaacagtgacctcgccagc

SEQ ID NO: 6365 - DNA, 21 bp, synthetic construct
  misc_feature 1..21: note = n-mer motif encoding polynucleotide
  source 1..21: mol_type = other DNA
cgcatcgtagacacgttggga

SEQ ID NO: 6366 - DNA, 21 bp, synthetic construct
  misc_feature 1..21: note = n-mer motif encoding polynucleotide
  source 1..21: mol_type = other DNA
cacacttactcacaagcagac

SEQ ID NO: 6367 - DNA, 21 bp, synthetic construct
  misc_feature 1..21: note = n-mer motif encoding polynucleotide
  source 1..21: mol_type = other DNA
acggctccatccgtagggtct

SEQ ID NO: 6368 - DNA, 21 bp, synthetic construct
  misc_feature 1..21: note = n-mer motif encoding polynucleotide
  source 1..21: mol_type = other DNA
aacgtgggcaccgacagagac

SEQ ID NO: 6369 - DNA, 21 bp, synthetic construct
  misc_feature 1..21: note = n-mer motif encoding polynucleotide
  source 1..21: mol_type = other DNA
gggattaatcgtactagtgag

SEQ ID NO: 6370 - DNA, 21 bp, synthetic construct
  misc_feature 1..21: note = n-mer motif encoding polynucleotide
  source 1..21: mol_type = other DNA
gtagaaacagacagcttaata

SEQ ID NO: 6371 - DNA, 21 bp, synthetic construct
  misc_feature 1..21: note = n-mer motif encoding polynucleotide
  source 1..21: mol_type = other DNA
cactccgcagcgggtgacggt

SEQ ID NO: 6372 - DNA, 21 bp, synthetic construct
  misc_feature 1..21: note = n-mer motif encoding polynucleotide
  source 1..21: mol_type = other DNA
gatgctgggattagttcttat

SEQ ID NO: 6373 - DNA, 21 bp, synthetic construct
  misc_feature 1..21: note = n-mer motif encoding polynucleotide
  source 1..21: mol_type = other DNA
tgcaccgccacaaaatgctca

SEQ ID NO: 6374 - DNA, 21 bp, synthetic construct
  misc_feature 1..21: note = n-mer motif encoding polynucleotide
  source 1..21: mol_type = other DNA
cgcatagacactctcctagtc

SEQ ID NO: 6375 - DNA, 21 bp, synthetic construct
  misc_feature 1..21: note = n-mer motif encoding polynucleotide
  source 1..21: mol_type = other DNA
gtatcacaatcacacgacgtg

SEQ ID NO: 6376 - DNA, 21 bp, synthetic construct
  misc_feature 1..21: note = n-mer motif encoding polynucleotide
  source 1..21: mol_type = other DNA
gcactaccatcccactcctcc

SEQ ID NO: 6377 - DNA, 21 bp, synthetic construct
  misc_feature 1..21: note = n-mer motif encoding polynucleotide
  source 1..21: mol_type = other DNA
gggaaacctgcggaagcgccg

SEQ ID NO: 6378 - DNA, 21 bp, synthetic construct
  misc_feature 1..21: note = n-mer motif encoding polynucleotide
  source 1..21: mol_type = other DNA
tggaatagtccgggtgaggcg

SEQ ID NO: 6379 - DNA, 21 bp, synthetic construct
  misc_feature 1..21: note = n-mer motif encoding polynucleotide
  source 1..21: mol_type = other DNA
aggctggagcgtccggattat

SEQ ID NO: 6380 - DNA, 21 bp, synthetic construct
  misc_feature 1..21: note = n-mer motif encoding polynucleotide
  source 1..21: mol_type = other DNA
acgcgggagagtctggtggat

SEQ ID NO: 6381 - DNA, 21 bp, synthetic construct
  misc_feature 1..21: note = n-mer motif encoding polynucleotide
  source 1..21: mol_type = other DNA
agacacgaaggtccgtactcc

SEQ ID NO: 6382 - DNA, 21 bp, synthetic construct
  misc_feature 1..21: note = n-mer motif encoding polynucleotide
  source 1..21: mol_type = other DNA
gttttgtctgataaggcgttt

SEQ ID NO: 6383 - DNA, 21 bp, synthetic construct
  misc_feature 1..21: note = n-mer motif encoding polynucleotide
  source 1..21: mol_type = other DNA
actagtgcgactgattcgatg

SEQ ID NO: 6384 - DNA, 21 bp, synthetic construct
  misc_feature 1..21: note = n-mer motif encoding polynucleotide
  source 1..21: mol_type = other DNA
actgagccgcttccgatgtct

SEQ ID NO: 6385 - DNA, 21 bp, synthetic construct
  misc_feature 1..21: note = n-mer motif encoding polynucleotide
  source 1..21: mol_type = other DNA
atgccttacgtcgggacagta

SEQ ID NO: 6386 - DNA, 21 bp, synthetic construct
  misc_feature 1..21: note = n-mer motif encoding polynucleotide
  source 1..21: mol_type = other DNA
cgtgattattctcctactgat

SEQ ID NO: 6387 - DNA, 21 bp, synthetic construct
  misc_feature 1..21: note = n-mer motif encoding polynucleotide
  source 1..21: mol_type = other DNA
cggaatggtggtactacggat

SEQ ID NO: 6388 - DNA, 21 bp, synthetic construct
  misc_feature 1..21: note = n-mer motif encoding polynucleotide
  source 1..21: mol_type = other DNA
atgatgggcgcgacaacgaaa

SEQ ID NO: 6389 - DNA, 21 bp, synthetic construct
  misc_feature 1..21: note = n-mer motif encoding polynucleotide
  source 1..21: mol_type = other DNA
gctgccgttggcggagacacc

SEQ ID NO: 6390 - DNA, 21 bp, synthetic construct
  misc_feature 1..21: note = n-mer motif encoding polynucleotide
  source 1..21: mol_type = other DNA
cttgtgaataatgatgggact

SEQ ID NO: 6391 - DNA, 21 bp, synthetic construct
  misc_feature 1..21: note = n-mer motif encoding polynucleotide
  source 1..21: mol_type = other DNA
agttcgactccgcaggatact

SEQ ID NO: 6392 - DNA, 21 bp, synthetic construct
  misc_feature 1..21: note = n-mer motif encoding polynucleotide
  source 1..21: mol_type = other DNA
agtctgcggatggagaatagt

SEQ ID NO: 6393 - DNA, 21 bp, synthetic construct
  misc_feature 1..21: note = n-mer motif encoding polynucleotide
  source 1..21: mol_type = other DNA
gtgcaggggcagaccggctgg

SEQ ID NO: 6394 - DNA, 21 bp, synthetic construct
  misc_feature 1..21: note = n-mer motif encoding polynucleotide
  source 1..21: mol_type = other DNA
ctaggtttcacaccccaaccg

SEQ ID NO: 6395 - DNA, 21 bp, synthetic construct
  misc_feature 1..21: note = n-mer motif encoding polynucleotide
  source 1..21: mol_type = other DNA
tcggttgctaaggatcagacg

SEQ ID NO: 6396 - DNA, 21 bp, synthetic construct
  misc_feature 1..21: note = n-mer motif encoding polynucleotide
  source 1..21: mol_type = other DNA
ccgcggcatgagttgagtaat

SEQ ID NO: 6397 - DNA, 21 bp, synthetic construct
  misc_feature 1..21: note = n-mer motif encoding polynucleotide
  source 1..21: mol_type = other DNA
aaaatgggatcgaaccccgca

SEQ ID NO: 6398 - DNA, 21 bp, synthetic construct
  misc_feature 1..21: note = n-mer motif encoding polynucleotide
  source 1..21: mol_type = other DNA
gaggcgactcatggttcttat

SEQ ID NO: 6399 - DNA, 21 bp, synthetic construct
  misc_feature 1..21: note = n-mer motif encoding polynucleotide
  source 1..21: mol_type = other DNA
cctgaggttgcgtgtcctggg

SEQ ID NO: 6400 - DNA, 21 bp, synthetic construct
  misc_feature 1..21: note = n-mer motif encoding polynucleotide
  source 1..21: mol_type = other DNA
gtgaatacgcgggaggttacg

SEQ ID NO: 6401 - DNA, 21 bp, synthetic construct
  misc_feature 1..21: note = n-mer motif encoding polynucleotide
  source 1..21: mol_type = other DNA
acggctcgtgcgattgatatg

SEQ ID NO: 6402 - DNA, 21 bp, synthetic construct
  misc_feature 1..21: note = n-mer motif encoding polynucleotide
  source 1..21: mol_type = other DNA
accgacggcgccctgggttac

SEQ ID NO: 6403 - DNA, 21 bp, synthetic construct
  misc_feature 1..21: note = n-mer motif encoding polynucleotide
  source 1..21: mol_type = other DNA
gggtcgcaatacgcgaaccgc

SEQ ID NO: 6404 - DNA, 21 bp, synthetic construct
  misc_feature 1..21: note = n-mer motif encoding polynucleotide
  source 1..21: mol_type = other DNA
gaaatgggtaaccaataccca

SEQ ID NO: 6405 - DNA, 21 bp, synthetic construct
  misc_feature 1..21: note = n-mer motif encoding polynucleotide
  source 1..21: mol_type = other DNA
ccgtcgacactcgctgaaaca

SEQ ID NO: 6406 - DNA, 21 bp, synthetic construct
  misc_feature 1..21: note = n-mer motif encoding polynucleotide
  source 1..21: mol_type = other DNA
cgcataggcgttggagcacca

SEQ ID NO: 6407 - DNA, 21 bp, synthetic construct
  misc_feature 1..21: note = n-mer motif encoding polynucleotide
  source 1..21: mol_type = other DNA
ctgagtgtgaaggaggagatt

SEQ ID NO: 6408 - DNA, 21 bp, synthetic construct
  misc_feature 1..21: note = n-mer motif encoding polynucleotide
  source 1..21: mol_type = other DNA
tatactactcatgagagtggg

SEQ ID NO: 6409 - DNA, 21 bp, synthetic construct
  misc_feature 1..21: note = n-mer motif encoding polynucleotide
  source 1..21: mol_type = other DNA
cttactgctgttctgactgtt

SEQ ID NO: 6410 - DNA, 21 bp, synthetic construct
  misc_feature 1..21: note = n-mer motif encoding polynucleotide
  source 1..21: mol_type = other DNA
ctgcagacttctgttgctact

SEQ ID NO: 6411 - DNA, 21 bp, synthetic construct
  misc_feature 1..21: note = n-mer motif encoding polynucleotide
  source 1..21: mol_type = other DNA
actgtgcgttcgcctcagccg

SEQ ID NO: 6412 - DNA, 21 bp, synthetic construct
  misc_feature 1..21: note = n-mer motif encoding polynucleotide
  source 1..21: mol_type = other DNA
catcctgatggtactcggccg

SEQ ID NO: 6413 - DNA, 21 bp, synthetic construct
  misc_feature 1..21: note = n-mer motif encoding polynucleotide
  source 1..21: mol_type = other DNA
ggagtaacaatcggtagcagg

SEQ ID NO: 6414 - DNA, 21 bp, synthetic construct
  misc_feature 1..21: note = n-mer motif encoding polynucleotide
  source 1..21: mol_type = other DNA
acatacgcctctactgaagcg

SEQ ID NO: 6415 - DNA, 21 bp, synthetic construct
  misc_feature 1..21: note = n-mer motif encoding polynucleotide
  source 1..21: mol_type = other DNA
aggagtagtcctgcgacgaat

SEQ ID NO: 6416 - DNA, 21 bp, synthetic construct
  misc_feature 1..21: note = n-mer motif encoding polynucleotide
  source 1..21: mol_type = other DNA
atcgggtcgccgttggccaac

SEQ ID NO: 6417 - DNA, 21 bp, synthetic construct
  misc_feature 1..21: note = n-mer motif encoding polynucleotide
  source 1..21: mol_type = other DNA
gcgtcgactgagtctcatgtg

SEQ ID NO: 6418 - DNA, 21 bp, synthetic construct
  misc_feature 1..21: note = n-mer motif encoding polynucleotide
  source 1..21: mol_type = other DNA
attgcgcagaatgagacgtat

SEQ ID NO: 6419 - DNA, 21 bp, synthetic construct
  misc_feature 1..21: note = n-mer motif encoding polynucleotide
  source 1..21: mol_type = other DNA
atggagtctaagccgtggcag

SEQ ID NO: 6420 - DNA, 21 bp, synthetic construct
  misc_feature 1..21: note = n-mer motif encoding polynucleotide
  source 1..21: mol_type = other DNA
ttagaaaacccaacaccagca

SEQ ID NO: 6421 - DNA, 21 bp, synthetic construct
  misc_feature 1..21: note = n-mer motif encoding polynucleotide
  source 1..21: mol_type = other DNA
cccaaccccagtccaagacaa

SEQ ID NO: 6422 - DNA, 21 bp, synthetic construct
  misc_feature 1..21: note = n-mer motif encoding polynucleotide
  source 1..21: mol_type = other DNA
tcgactagtaatccgccttat

SEQ ID NO: 6423 - DNA, 21 bp, synthetic construct
  misc_feature 1..21: note = n-mer motif encoding polynucleotide
  source 1..21: mol_type = other DNA
tatttgacggatactcctact

SEQ ID NO: 6424 - DNA, 21 bp, synthetic construct
  misc_feature 1..21: note = n-mer motif encoding polynucleotide
  source 1..21: mol_type = other DNA
atacgtgcattgatgacggac

SEQ ID NO: 6425 - DNA, 21 bp, synthetic construct
  misc_feature 1..21: note = n-mer motif encoding polynucleotide
  source 1..21: mol_type = other DNA
cctatgggtacggatacggtt

SEQ ID NO: 6426 - DNA, 21 bp, synthetic construct
  misc_feature 1..21: note = n-mer motif encoding polynucleotide
  source 1..21: mol_type = other DNA
acgaggactcaggggacgtct

SEQ ID NO: 6427 - DNA, 21 bp, synthetic construct
  misc_feature 1..21: note = n-mer motif encoding polynucleotide
  source 1..21: mol_type = other DNA
tctaataatatgaatcaggcg

SEQ ID NO: 6428 - DNA, 21 bp, synthetic construct
  misc_feature 1..21: note = n-mer motif encoding polynucleotide
  source 1..21: mol_type = other DNA
gaagactctgtaaaccacatc

SEQ ID NO: 6429 - DNA, 21 bp, synthetic construct
  misc_feature 1..21: note = n-mer motif encoding polynucleotide
  source 1..21: mol_type = other DNA
tctgttgtgcctacggataag

SEQ ID NO: 6430 - DNA, 21 bp, synthetic construct
  misc_feature 1..21: note = n-mer motif encoding polynucleotide
  source 1..21: mol_type = other DNA
gtgcgcggcgttcaagacgcc

SEQ ID NO: 6431 - DNA, 21 bp, synthetic construct
  misc_feature 1..21: note = n-mer motif encoding polynucleotide
  source 1..21: mol_type = other DNA
catgatgtgactgtgcggaat

SEQ ID NO: 6432 - DNA, 21 bp, synthetic construct
  misc_feature 1..21: note = n-mer motif encoding polynucleotide
  source 1..21: mol_type = other DNA
cataataatcatgcgggtgag

SEQ ID NO: 6433 - DNA, 21 bp, synthetic construct
  misc_feature 1..21: note = n-mer motif encoding polynucleotide
  source 1..21: mol_type = other DNA
ggtaatatgaatcatagtatt

SEQ ID NO: 6434 - DNA, 21 bp, synthetic construct
  misc_feature 1..21: note = n-mer motif encoding polynucleotide
  source 1..21: mol_type = other DNA
ggtgtgcatactcatactgtt

SEQ ID NO: 6435 - DNA, 21 bp, synthetic construct
  misc_feature 1..21: note = n-mer motif encoding polynucleotide
  source 1..21: mol_type = other DNA
tttttgccgcagctggggcag

SEQ ID NO: 6436 - DNA, 21 bp, synthetic construct
  misc_feature 1..21: note = n-mer motif encoding polynucleotide
  source 1..21: mol_type = other DNA
ttggccaacatgtccgcacca

SEQ ID NO: 6437 - DNA, 21 bp, synthetic construct
  misc_feature 1..21: note = n-mer motif encoding polynucleotide
  source 1..21: mol_type = other DNA
gttcgcagagacgaaacacct

SEQ ID NO: 6438 - DNA, 21 bp, synthetic construct
  misc_feature 1..21: note = n-mer motif encoding polynucleotide
  source 1..21: mol_type = other DNA
tgccgcgacaacgtcttagct

SEQ ID NO: 6439 - DNA, 21 bp, synthetic construct
  misc_feature 1..21: note = n-mer motif encoding polynucleotide
  source 1..21: mol_type = other DNA
atgttggcttctcgggtgcct

SEQ ID NO: 6440 - DNA, 21 bp, synthetic construct
  misc_feature 1..21: note = n-mer motif encoding polynucleotide
  source 1..21: mol_type = other DNA
gtcagaacagtccttcaacaa

SEQ ID NO: 6441 - DNA, 21 bp, synthetic construct
  misc_feature 1..21: note = n-mer motif encoding polynucleotide
  source 1..21: mol_type = other DNA
tcgaatcagaatgtggattgg

SEQ ID NO: 6442 - DNA, 21 bp, synthetic construct
  misc_feature 1..21: note = n-mer motif encoding polynucleotide
  source 1..21: mol_type = other DNA
actgaggttacgggggatagt

SEQ ID NO: 6443 - DNA, 21 bp, synthetic construct
  misc_feature 1..21: note = n-mer motif encoding polynucleotide
  source 1..21: mol_type = other DNA
gaaagtgccacatctctaaaa

SEQ ID NO: 6444 - DNA, 21 bp, synthetic construct
  misc_feature 1..21: note = n-mer motif encoding polynucleotide
  source 1..21: mol_type = other DNA
aaccaccccgcaccaagctca

SEQ ID NO: 6445 - DNA, 21 bp, synthetic construct
  misc_feature 1..21: note = n-mer motif encoding polynucleotide
  source 1..21: mol_type = other DNA
tacggtaacgcgaacaccgta

SEQ ID NO: 6446 - DNA, 21 bp, synthetic construct
  misc_feature 1..21: note = n-mer motif encoding polynucleotide
  source 1..21: mol_type = other DNA
caaaacgacaaatctgacaac

SEQ ID NO: 6447 - DNA, 21 bp, synthetic construct
  misc_feature 1..21: note = n-mer motif encoding polynucleotide
  source 1..21: mol_type = other DNA
agtcaggctcagattcgtgtt

SEQ ID NO: 6448 - DNA, 21 bp, synthetic construct
  misc_feature 1..21: note = n-mer motif encoding polynucleotide
  source 1..21: mol_type = other DNA
tttcagcgtgatgttggtcat

SEQ ID NO: 6449 - DNA, 21 bp, synthetic construct
  misc_feature 1..21: note = n-mer motif encoding polynucleotide
  source 1..21: mol_type = other DNA
ctgatgaatcgtaatgctcct

SEQ ID NO: 6450 - DNA, 21 bp, synthetic construct
  misc_feature 1..21: note = n-mer motif encoding polynucleotide
  source 1..21: mol_type = other DNA
gcgggcagttcgccatcacgc

SEQ ID NO: 6451 - DNA, 21 bp, synthetic construct
  misc_feature 1..21: note = n-mer motif encoding polynucleotide
  source 1..21: mol_type = other DNA
ttattccacagccaaatgacc

SEQ ID NO: 6452 - DNA, 21 bp, synthetic construct
  misc_feature 1..21: note = n-mer motif encoding polynucleotide
  source 1..21: mol_type = other DNA
atgatgtctaacagcctcgcg

SEQ ID NO: 6453 - DNA, 21 bp, synthetic construct
  misc_feature 1..21: note = n-mer motif encoding polynucleotide
  source 1..21: mol_type = other DNA
gttaccaccgtcctccaatca

SEQ ID NO: 6454 - DNA, 21 bp, synthetic construct
  misc_feature 1..21: note = n-mer motif encoding polynucleotide
  source 1..21: mol_type = other DNA
ggtagtcagcgtgctatgaat

SEQ ID NO: 6455 - DNA, 21 bp, synthetic construct
  misc_feature 1..21: note = n-mer motif encoding polynucleotide
  source 1..21: mol_type = other DNA
gcatccggcgcacgctacgtc

SEQ ID NO: 6456 - DNA, 21 bp, synthetic construct
  misc_feature 1..21: note = n-mer motif encoding polynucleotide
  source 1..21: mol_type = other DNA
aaaaactacgacagtgactca

SEQ ID NO: 6457 - DNA, 21 bp, synthetic construct
  misc_feature 1..21: note = n-mer motif encoding polynucleotide
  source 1..21: mol_type = other DNA
gtgggttctggggttggggtt

SEQ ID NO: 6458 - DNA, 21 bp, synthetic construct
  misc_feature 1..21: note = n-mer motif encoding polynucleotide
  source 1..21: mol_type = other DNA
cgttctgaccttactgaaagt

SEQ ID NO: 6459 - DNA, 21 bp, synthetic construct
  misc_feature 1..21: note = n-mer motif encoding polynucleotide
  source 1..21: mol_type = other DNA
agggcggagtttattgatacg

SEQ ID NO: 6460 - DNA, 21 bp, synthetic construct
  misc_feature 1..21: note = n-mer motif encoding polynucleotide
  source 1..21: mol_type = other DNA
acatctgaaatgcggacagcc

SEQ ID NO: 6461 - DNA, 21 bp, synthetic construct
  misc_feature 1..21: note = n-mer motif encoding polynucleotide
  source 1..21: mol_type = other DNA
gagttggatcatctttcgcat

SEQ ID NO: 6462 - DNA, 21 bp, synthetic construct
  misc_feature 1..21: note = n-mer motif encoding polynucleotide
  source 1..21: mol_type = other DNA
acacaagcaggtcttgcgtca

SEQ ID NO: 6463 - DNA, 21 bp, synthetic construct
  misc_feature 1..21: note = n-mer motif encoding polynucleotide
  source 1..21: mol_type = other DNA
gcggctcagcatcatgatacg

SEQ ID NO: 6464 - DNA, 21 bp, synthetic construct
  misc_feature 1..21: note = n-mer motif encoding polynucleotide
  source 1..21: mol_type = other DNA
ggcggcgcacacactcgtgta

SEQ ID NO: 6465 - DNA, 21 bp, synthetic construct
  misc_feature 1..21: note = n-mer motif encoding polynucleotide
  source 1..21: mol_type = other DNA
gcctacggtatacacgaagtg

SEQ ID NO: 6466 - DNA, 21 bp, synthetic construct
  misc_feature 1..21: note = n-mer motif encoding polynucleotide
  source 1..21: mol_type = other DNA
gcgatgctgcgtatggagcag

SEQ ID NO: 6467 - DNA, 21 bp, synthetic construct
  misc_feature 1..21: note = n-mer motif encoding polynucleotide
  source 1..21: mol_type = other DNA
acggatcgttcgcggctgggg

SEQ ID NO: 6468 - DNA, 21 bp, synthetic construct
  misc_feature 1..21: note = n-mer motif encoding polynucleotide
  source 1..21: mol_type = other DNA
gagagggagcctcctaagaat

SEQ ID NO: 6469 - DNA, 21 bp, synthetic construct
  misc_feature 1..21: note = n-mer motif encoding polynucleotide
  source 1..21: mol_type = other DNA
gttgttaaggagattaagctg

SEQ ID NO: 6470 - DNA, 21 bp, synthetic construct
  misc_feature 1..21: note = n-mer motif encoding polynucleotide
  source 1..21: mol_type = other DNA
cacaccggccaaacaccatca

SEQ ID NO: 6471 - DNA, 21 bp, synthetic construct
  misc_feature 1..21: note = n-mer motif encoding polynucleotide
  source 1..21: mol_type = other DNA
gtgtctctgagttcgcctccg

SEQ ID NO: 6472 - DNA, 21 bp, synthetic construct
  misc_feature 1..21: note = n-mer motif encoding polynucleotide
  source 1..21: mol_type = other DNA
ggggcaggaaacctgggtacc

SEQ ID NO: 6473 - DNA, 21 bp, synthetic construct
  misc_feature 1..21: note = n-mer motif encoding polynucleotide
  source 1..21: mol_type = other DNA
gcacgagacgacacgatacaa

SEQ ID NO: 6474 - DNA, 21 bp, synthetic construct
  misc_feature 1..21: note = n-mer motif encoding polynucleotide
  source 1..21: mol_type = other DNA
gggacttatactaatatgccg

SEQ ID NO: 6475 - DNA, 21 bp, synthetic construct
  misc_feature 1..21: note = n-mer motif encoding polynucleotide
  source 1..21: mol_type = other DNA
atgctggggggttttgcgcag

SEQ ID NO: 6476 - DNA, 21 bp, synthetic construct
  misc_feature 1..21: note = n-mer motif encoding polynucleotide
  source 1..21: mol_type = other DNA
ccatccgaaatgagggccgta

SEQ ID NO: 6477 - DNA, 21 bp, synthetic construct
  misc_feature 1..21: note = n-mer motif encoding polynucleotide
  source 1..21: mol_type = other DNA
cgtataagcccagaaaactca

SEQ ID NO: 6478 - DNA, 21 bp, synthetic construct
  misc_feature 1..21: note = n-mer motif encoding polynucleotide
  source 1..21: mol_type = other DNA
aagatgggtggttctcagagt

SEQ ID NO: 6479 - DNA, 21 bp, synthetic construct
  misc_feature 1..21: note = n-mer motif encoding polynucleotide
  source 1..21: mol_type = other DNA
ggtttgatggcgcatgtgact

SEQ ID NO: 6480 - DNA, 21 bp, synthetic construct
  misc_feature 1..21: note = n-mer motif encoding polynucleotide
  source 1..21: mol_type = other DNA
tcacgtcaaacagcgctaaca

SEQ ID NO: 6481 - DNA, 21 bp, synthetic construct
  misc_feature 1..21: note = n-mer motif encoding polynucleotide
  source 1..21: mol_type = other DNA
agtgatctgaatcttccgccg

SEQ ID NO: 6482 - DNA, 21 bp, synthetic construct
  misc_feature 1..21: note = n-mer motif encoding polynucleotide
  source 1..21: mol_type = other DNA
tatgtgtctgattatttgcat

SEQ ID NO: 6483 - DNA, 21 bp, synthetic construct
  misc_feature 1..21: note = n-mer motif encoding polynucleotide
  source 1..21: mol_type = other DNA
actaatgataatagtgatcgt

SEQ ID NO: 6484 - DNA, 21 bp, synthetic construct
  misc_feature 1..21: note = n-mer motif encoding polynucleotide
  source 1..21: mol_type = other DNA
tacttaatgcacgacagcgca

SEQ ID NO: 6485 - DNA, 21 bp, synthetic construct
  misc_feature 1..21: note = n-mer motif encoding polynucleotide
  source 1..21: mol_type = other DNA
ggctctcggaacggacccaca

SEQ ID NO: 6486 - DNA, 21 bp, synthetic construct
  misc_feature 1..21: note = n-mer motif encoding polynucleotide
  source 1..21: mol_type = other DNA
aaaaacggtgttataaacgac

SEQ ID NO: 6487 - DNA, 21 bp, synthetic construct
  misc_feature 1..21: note = n-mer motif encoding polynucleotide
  source 1..21: mol_type = other DNA
gagtctgttgctaatcttaag

SEQ ID NO: 6488 - DNA, 21 bp, synthetic construct
  misc_feature 1..21: note = n-mer motif encoding polynucleotide
  source 1..21: mol_type = other DNA
gcatcggactcgacgacacca

SEQ ID NO: 6489 - DNA, 21 bp, synthetic construct
  misc_feature 1..21: note = n-mer motif encoding polynucleotide
  source 1..21: mol_type = other DNA
ctgaacgttagttcatccaaa

SEQ ID NO: 6490 - DNA, 21 bp, synthetic construct
  misc_feature 1..21: note = n-mer motif encoding polynucleotide
  source 1..21: mol_type = other DNA
gaggctaagggttttggtcat

SEQ ID NO: 6491 - DNA, 21 bp, synthetic construct
  misc_feature 1..21: note = n-mer motif encoding polynucleotide
  source 1..21: mol_type = other DNA
ggtacgagtgcggagagtcgg

SEQ ID NO: 6492 - DNA, 21 bp, synthetic construct
  misc_feature 1..21: note = n-mer motif encoding polynucleotide
  source 1..21: mol_type = other DNA
atgcacaacctaccctcatac

SEQ ID NO: 6493 - DNA, 21 bp, synthetic construct
  misc_feature 1..21: note = n-mer motif encoding polynucleotide
  source 1..21: mol_type = other DNA
gtcttcacagaaatagaatcg

SEQ ID NO: 6494 - DNA, 21 bp, synthetic construct
  misc_feature 1..21: note = n-mer motif encoding polynucleotide
  source 1..21: mol_type = other DNA
actcaaacttctacctggacc

SEQ ID NO: 6495 - DNA, 21 bp, synthetic construct
  misc_feature 1..21: note = n-mer motif encoding polynucleotide
  source 1..21: mol_type = other DNA
cctatgaataaggatattttg

SEQ ID NO: 6496 - DNA, 21 bp, synthetic construct
  misc_feature 1..21: note = n-mer motif encoding polynucleotide
  source 1..21: mol_type = other DNA
aaagaatctgaatacagagtt

SEQ ID NO: 6497 - DNA, 21 bp, synthetic construct
  misc_feature 1..21: note = n-mer motif encoding polynucleotide
  source 1..21: mol_type = other DNA
tcgacgaattctgaggcggtt

SEQ ID NO: 6498 - DNA, 21 bp, synthetic construct
  misc_feature 1..21: note = n-mer motif encoding polynucleotide
  source 1..21: mol_type = other DNA
gatacggcgaatcgttcgact

SEQ ID NO: 6499 - DNA, 21 bp, synthetic construct
  misc_feature 1..21: note = n-mer motif encoding polynucleotide
  source 1..21: mol_type = other DNA
cctaaggctccgcttaataat

SEQ ID NO: 6500 - DNA, 21 bp, synthetic construct
  misc_feature 1..21: note = n-mer motif encoding polynucleotide
  source 1..21: mol_type = other DNA
ttagctacatacccctcccac

SEQ ID NO: 6501 - DNA, 21 bp, synthetic construct
  misc_feature 1..21: note = n-mer motif encoding polynucleotide
  source 1..21: mol_type = other DNA
gctacggttcagtcggttgat

SEQ ID NO: 6502 - DNA, 21 bp, synthetic construct
  misc_feature 1..21: note = n-mer motif encoding polynucleotide
  source 1..21: mol_type = other DNA
aattcgatgggtaatgggggt

SEQ ID NO: 6503 - DNA, 21 bp, synthetic construct
  misc_feature 1..21: note = n-mer motif encoding polynucleotide
  source 1..21: mol_type = other DNA
gatcatagtgagcagaattcg

SEQ ID NO: 6504 - DNA, 21 bp, synthetic construct
  misc_feature 1..21: note = n-mer motif encoding polynucleotide
  source 1..21: mol_type = other DNA
acttttttgcctcagcttggg

SEQ ID NO: 6505 - DNA, 21 bp, synthetic construct
  misc_feature 1..21: note = n-mer motif encoding polynucleotide
  source 1..21: mol_type = other DNA
gggtttactaatacgagtaag

SEQ ID NO: 6506 - DNA, 21 bp, synthetic construct
  misc_feature 1..21: note = n-mer motif encoding polynucleotide
  source 1..21: mol_type = other DNA
acgatgaattatagtcatact

SEQ ID NO: 6507 - DNA, 21 bp, synthetic construct
  misc_feature 1..21: note = n-mer motif encoding polynucleotide
  source 1..21: mol_type = other DNA
agtatcggattctcagtaggc

SEQ ID NO: 6508 - DNA, 21 bp, synthetic construct
  misc_feature 1..21: note = n-mer motif encoding polynucleotide
  source 1..21: mol_type = other DNA
agtgagaatcgggctggtaat

SEQ ID NO: 6509 - DNA, 21 bp, synthetic construct
  misc_feature 1..21: note = n-mer motif encoding polynucleotide
  source 1..21: mol_type = other DNA
agtcttaatctgcatagtgtg

SEQ ID NO: 6510 - DNA, 21 bp, synthetic construct
  misc_feature 1..21: note = n-mer motif encoding polynucleotide
  source 1..21: mol_type = other DNA
catgagagtcattatgttagt

SEQ ID NO: 6511 - DNA, 21 bp, synthetic construct
  misc_feature 1..21: note = n-mer motif encoding polynucleotide
  source 1..21: mol_type = other DNA
aatgttgttaatgggatggat

SEQ ID NO: 6512 - DNA, 21 bp, synthetic construct
  misc_feature 1..21: note = n-mer motif encoding polynucleotide
  source 1..21: mol_type = other DNA
cactccgacaaagtctcctca

SEQ ID NO: 6513 - DNA, 21 bp, synthetic construct
  misc_feature 1..21: note = n-mer motif encoding polynucleotide
  source 1..21: mol_type = other DNA
aaatctgtaggcgacgggaga

SEQ ID NO: 6514 - DNA, 21 bp, synthetic construct
  misc_feature 1..21: note = n-mer motif encoding polynucleotide
  source 1..21: mol_type = other DNA
aggcaggttgagcagtctgat

SEQ ID NO: 6515 - DNA, 21 bp, synthetic construct
  misc_feature 1..21: note = n-mer motif encoding polynucleotide
  source 1..21: mol_type = other DNA
agggagctggtgaatacggat

SEQ ID NO: 6516 - DNA, 21 bp, synthetic construct
  misc_feature 1..21: note = n-mer motif encoding polynucleotide
  source 1..21: mol_type = other DNA
aactacagggacatcacaatg

SEQ ID NO: 6517 - DNA, 21 bp, synthetic construct
  misc_feature 1..21: note = n-mer motif encoding polynucleotide
  source 1..21: mol_type = other DNA
gccagccttgaccgccttcca

SEQ ID NO: 6518 - DNA, 21 bp, synthetic construct
  misc_feature 1..21: note = n-mer motif encoding polynucleotide
  source 1..21: mol_type = other DNA
agacaacttgcttctctccca

SEQ ID NO: 6519 - DNA, 21 bp, synthetic construct
  misc_feature 1..21: note = n-mer motif encoding polynucleotide
  source 1..21: mol_type = other DNA
gtcagcaaaaccaaagactcg

SEQ ID NO: 6520 - DNA, 21 bp, synthetic construct
  misc_feature 1..21: note = n-mer motif encoding polynucleotide
  source 1..21: mol_type = other DNA
aacgtatacgaagggcaccgc

SEQ ID NO: 6521 - DNA, 21 bp, synthetic construct
  misc_feature 1..21: note = n-mer motif encoding polynucleotide
  source 1..21: mol_type = other DNA
ctagaacaactacgggtccca

SEQ ID NO: 6522 - DNA, 21 bp, synthetic construct
  misc_feature 1..21: note = n-mer motif encoding polynucleotide
  source 1..21: mol_type = other DNA
atgacctacacatccccaacc

SEQ ID NO: 6523 - DNA, 21 bp, synthetic construct
  misc_feature 1..21: note = n-mer motif encoding polynucleotide
  source 1..21: mol_type = other DNA
aactcccacaccgacagagga

SEQ ID NO: 6524 - DNA, 21 bp, synthetic construct
  misc_feature 1..21: note = n-mer motif encoding polynucleotide
  source 1..21: mol_type = other DNA
gtggctggggggacttcggag

SEQ ID NO: 6525 - DNA, 21 bp, synthetic construct
  misc_feature 1..21: note = n-mer motif encoding polynucleotide
  source 1..21: mol_type = other DNA
gtcgacgcacacagggctaac

SEQ ID NO: 6526 - DNA, 21 bp, synthetic construct
  misc_feature 1..21: note = n-mer motif encoding polynucleotide
  source 1..21: mol_type = other DNA
cgggcagacatgactccctta

SEQ ID NO: 6527 - DNA, 21 bp, synthetic construct
  misc_feature 1..21: note = n-mer motif encoding polynucleotide
  source 1..21: mol_type = other DNA
ggacacgaacaaactgacgca

SEQ ID NO: 6528 - DNA, 21 bp, synthetic construct
  misc_feature 1..21: note = n-mer motif encoding polynucleotide
  source 1..21: mol_type = other DNA
tacatcgcgggaggcgaccaa

SEQ ID NO: 6529 - DNA, 21 bp, synthetic construct
  misc_feature 1..21: note = n-mer motif encoding polynucleotide
  source 1..21: mol_type = other DNA
tacggcgacctaactacagtc

SEQ ID NO: 6530 - DNA, 21 bp, synthetic construct
  misc_feature 1..21: note = n-mer motif encoding polynucleotide
  source 1..21: mol_type = other DNA
agattagacctgcaagaacac

SEQ ID NO: 6531 - DNA, 21 bp, synthetic construct
  misc_feature 1..21: note = n-mer motif encoding polynucleotide
  source 1..21: mol_type = other DNA
caccttaacccggcggcccaa

SEQ ID NO: 6532 - DNA, 21 bp, synthetic construct
  misc_feature 1..21: note = n-mer motif encoding polynucleotide
  source 1..21: mol_type = other DNA
ggggttaacgaacaaacaaac

SEQ ID NO: 6533 - DNA, 21 bp, synthetic construct
  misc_feature 1..21: note = n-mer motif encoding polynucleotide
  source 1..21: mol_type = other DNA
cgtcggttgagtacggatctt

SEQ ID NO: 6534 - DNA, 21 bp, synthetic construct
  misc_feature 1..21: note = n-mer motif encoding polynucleotide
  source 1..21: mol_type = other DNA
ggatccacaggcctacccccg

SEQ ID NO: 6535 - DNA, 21 bp, synthetic construct
  misc_feature 1..21: note = n-mer motif encoding polynucleotide
  source 1..21: mol_type = other DNA
gacgacatggtcaaaaactca

SEQ ID NO: 6536 - DNA, 21 bp, synthetic construct
  misc_feature 1..21: note = n-mer motif encoding polynucleotide
  source 1..21: mol_type = other DNA
gttatagacctagtcactcgc

SEQ ID NO: 6537 - DNA, 21 bp, synthetic construct
  misc_feature 1..21: note = n-mer motif encoding polynucleotide
  source 1..21: mol_type = other DNA
ggaggccttaccaacggtcta

SEQ ID NO: 6538 - DNA, 21 bp, synthetic construct
  misc_feature 1..21: note = n-mer motif encoding polynucleotide
  source 1..21: mol_type = other DNA
cgtatggaggagactgcttat

SEQ ID NO: 6539 - DNA, 21 bp, synthetic construct
  misc_feature 1..21: note = n-mer motif encoding polynucleotide
  source 1..21: mol_type = other DNA
accgacatctccggttacgga

SEQ ID NO: 6540 - DNA, 21 bp, synthetic construct
  misc_feature 1..21: note = n-mer motif encoding polynucleotide
  source 1..21: mol_type = other DNA
caggttaatcataatactagt

SEQ ID NO: 6541 - DNA, 21 bp, synthetic construct
  misc_feature 1..21: note = n-mer motif encoding polynucleotide
  source 1..21: mol_type = other DNA
gcgactactgaggatgttcgt

SEQ ID NO: 6542 - DNA, 21 bp, synthetic construct
  misc_feature 1..21: note = n-mer motif encoding polynucleotide
  source 1..21: mol_type = other DNA
tggagcatcaaaaaccaaaca

SEQ ID NO: 6543 - DNA, 21 bp, synthetic construct
  misc_feature 1..21: note = n-mer motif encoding polynucleotide
  source 1..21: mol_type = other DNA
tcccctaccagcaacacaata

SEQ ID NO: 6544 - DNA, 21 bp, synthetic construct
  misc_feature 1..21: note = n-mer motif encoding polynucleotide
  source 1..21: mol_type = other DNA
atgaaaaactctggattcgac

SEQ ID NO: 6545 - DNA, 21 bp, synthetic construct
  misc_feature 1..21: note = n-mer motif encoding polynucleotide
  source 1..21: mol_type = other DNA
cttgttgctgagcgtttgccg

SEQ ID NO: 6546 - DNA, 21 bp, synthetic construct
  misc_feature 1..21: note = n-mer motif encoding polynucleotide
  source 1..21: mol_type = other DNA
ggtgaaactaacttcccaact

SEQ ID NO: 6547 - DNA, 21 bp, synthetic construct
  misc_feature 1..21: note = n-mer motif encoding polynucleotide
  source 1..21: mol_type = other DNA
aatggtaagctgggtacgact

SEQ ID NO: 6548 - DNA, 21 bp, synthetic construct
  misc_feature 1..21: note = n-mer motif encoding polynucleotide
  source 1..21: mol_type = other DNA
aacttagtagcgtacacgaaa

SEQ ID NO: 6549 - DNA, 21 bp, synthetic construct
  misc_feature 1..21: note = n-mer motif encoding polynucleotide
  source 1..21: mol_type = other DNA
tggcagcttacgacgagtcat

SEQ ID NO: 6550 - DNA, 21 bp, synthetic construct
  misc_feature 1..21: note = n-mer motif encoding polynucleotide
  source 1..21: mol_type = other DNA
agtttggacctaggaggcaac

SEQ ID NO: 6551 - DNA, 21 bp, synthetic construct
  misc_feature 1..21: note = n-mer motif encoding polynucleotide
  source 1..21: mol_type = other DNA
aacgaaagcaccaaagaatct

SEQ ID NO: 6552 - DNA, 21 bp, synthetic construct
  misc_feature 1..21: note = n-mer motif encoding polynucleotide
  source 1..21: mol_type = other DNA
ggttttgatggtaagcagctt

SEQ ID NO: 6553 - DNA, 21 bp, synthetic construct
  misc_feature 1..21: note = n-mer motif encoding polynucleotide
  source 1..21: mol_type = other DNA
catctgtatatttcggcggat

SEQ ID NO: 6554 - DNA, 21 bp, synthetic construct
  misc_feature 1..21: note = n-mer motif encoding polynucleotide
  source 1..21: mol_type = other DNA
ttacttccaaacaacacccac

SEQ ID NO: 6555 - DNA, 21 bp, synthetic construct
  misc_feature 1..21: note = n-mer motif encoding polynucleotide
  source 1..21: mol_type = other DNA
tccggaatggccggcctttcc

SEQ ID NO: 6556 - DNA, 21 bp, synthetic construct
  misc_feature 1..21: note = n-mer motif encoding polynucleotide
  source 1..21: mol_type = other DNA
atcacctcactccccgaaacc

SEQ ID NO: 6557 - DNA, 21 bp, synthetic construct
  misc_feature 1..21: note = n-mer motif encoding polynucleotide
  source 1..21: mol_type = other DNA
gagcttaaggagagtcagaag

SEQ ID NO: 6558 - DNA, 21 bp, synthetic construct
  misc_feature 1..21: note = n-mer motif encoding polynucleotide
  source 1..21: mol_type = other DNA
aatattgtgcaggattatccg

SEQ ID NO: 6559 - DNA, 21 bp, synthetic construct
  misc_feature 1..21: note = n-mer motif encoding polynucleotide
  source 1..21: mol_type = other DNA
tcagaaaacacctctgtaccc

SEQ ID NO: 6560 - DNA, 21 bp, synthetic construct
  misc_feature 1..21: note = n-mer motif encoding polynucleotide
  source 1..21: mol_type = other DNA
gaccccaaccaacccaaaaca

SEQ ID NO: 6561 - DNA, 21 bp, synthetic construct
  misc_feature 1..21: note = n-mer motif encoding polynucleotide
  source 1..21: mol_type = other DNA
gcgggtttggatgtgaatacg

SEQ ID NO: 6562 - DNA, 21 bp, synthetic construct
  misc_feature 1..21: note = n-mer motif encoding polynucleotide
  source 1..21: mol_type = other DNA
tctcatgagatgaataatggt

SEQ ID NO: 6563 - DNA, 21 bp, synthetic construct
  misc_feature 1..21: note = n-mer motif encoding polynucleotide
  source 1..21: mol_type = other DNA
tcttacgccataaaccaatca

SEQ ID NO: 6564 - DNA, 21 bp, synthetic construct
  misc_feature 1..21: note = n-mer motif encoding polynucleotide
  source 1..21: mol_type = other DNA
ggtcatctgcctgcggctaag

SEQ ID NO: 6565 - DNA, 21 bp, synthetic construct
  misc_feature 1..21: note = n-mer motif encoding polynucleotide
  source 1..21: mol_type = other DNA
gagttgggtaataagacggct

SEQ ID NO: 6566 - DNA, 21 bp, synthetic construct
  misc_feature 1..21: note = n-mer motif encoding polynucleotide
  source 1..21: mol_type = other DNA
cttgagtctactcgtaaggct

SEQ ID NO: 6567 - DNA, 21 bp, synthetic construct
  misc_feature 1..21: note = n-mer motif encoding polynucleotide
  source 1..21: mol_type = other DNA
actcaaggcaactctgaagca

SEQ ID NO: 6568 - DNA, 21 bp, synthetic construct
  misc_feature 1..21: note = n-mer motif encoding polynucleotide
  source 1..21: mol_type = other DNA
atctctatagactccgctatg

SEQ ID NO: 6569 - DNA, 21 bp, synthetic construct
  misc_feature 1..21: note = n-mer motif encoding polynucleotide
  source 1..21: mol_type = other DNA
gagtttcagaggattcgtgag

SEQ ID NO: 6570 - DNA, 21 bp, synthetic construct
  misc_feature 1..21: note = n-mer motif encoding polynucleotide
  source 1..21: mol_type = other DNA
gctagtctctccgcaccagcc

SEQ ID NO: 6571 - DNA, 21 bp, synthetic construct
  misc_feature 1..21: note = n-mer motif encoding polynucleotide
  source 1..21: mol_type = other DNA
gacagccaaatcacaagacta

SEQ ID NO: 6572 - DNA, 21 bp, synthetic construct
  misc_feature 1..21: note = n-mer motif encoding polynucleotide
  source 1..21: mol_type = other DNA
ggccacgaaaacatgggcgtg

SEQ ID NO: 6573 - DNA, 21 bp, synthetic construct
  misc_feature 1..21: note = n-mer motif encoding polynucleotide
  source 1..21: mol_type = other DNA
atgtcggcggggcatcctacg

SEQ ID NO: 6574 - DNA, 21 bp, synthetic construct
  misc_feature 1..21: note = n-mer motif encoding polynucleotide
  source 1..21: mol_type = other DNA
cacgctccaagcggcgccata

SEQ ID NO: 6575 - DNA, 21 bp, synthetic construct
  misc_feature 1..21: note = n-mer motif encoding polynucleotide
  source 1..21: mol_type = other DNA
acgactattactaattcggtt

SEQ ID NO: 6576 - DNA, 21 bp, synthetic construct
  misc_feature 1..21: note = n-mer motif encoding polynucleotide
  source 1..21: mol_type = other DNA
cctcagcatcagcatgagcat

SEQ ID NO: 6577 - DNA, 21 bp, synthetic construct
  misc_feature 1..21: note = n-mer motif encoding polynucleotide
  source 1..21: mol_type = other DNA
caatactcgatggacacgcgc

SEQ ID NO: 6578 - DNA, 21 bp, synthetic construct
  misc_feature 1..21: note = n-mer motif encoding polynucleotide
  source 1..21: mol_type = other DNA
ctttatgaggttggtactcct

SEQ ID NO: 6579 - DNA, 21 bp, synthetic construct
  misc_feature 1..21: note = n-mer motif encoding polynucleotide
  source 1..21: mol_type = other DNA
ggtgagactatgcgtcataat

SEQ ID NO: 6580 - DNA, 21 bp, synthetic construct
  misc_feature 1..21: note = n-mer motif encoding polynucleotide
  source 1..21: mol_type = other DNA
atgacaataaccgtcgaaccg

SEQ ID NO: 6581 - DNA, 21 bp, synthetic construct
  misc_feature 1..21: note = n-mer motif encoding polynucleotide
  source 1..21: mol_type = other DNA
gcgcagcatcctgagcgttcg

SEQ ID NO: 6582 - DNA, 21 bp, synthetic construct
  misc_feature 1..21: note = n-mer motif encoding polynucleotide
  source 1..21: mol_type = other DNA
acgcatgttgctaagcctgat

SEQ ID NO: 6583 - DNA, 21 bp, synthetic construct
  misc_feature 1..21: note = n-mer motif encoding polynucleotide
  source 1..21: mol_type = other DNA
atgactgctaacttggtggaa

SEQ ID NO: 6584 - DNA, 21 bp, synthetic construct
  misc_feature 1..21: note = n-mer motif encoding polynucleotide
  source 1..21: mol_type = other DNA
aataggcagcgggattttgag

SEQ ID NO: 6585 - DNA, 21 bp, synthetic construct
  misc_feature 1..21: note = n-mer motif encoding polynucleotide
  source 1..21: mol_type = other DNA
tcaaacagcgccgacgcgggg

SEQ ID NO: 6586 - DNA, 21 bp, synthetic construct
  misc_feature 1..21: note = n-mer motif encoding polynucleotide
  source 1..21: mol_type = other DNA
ggtgagtatggtgcgtcggtt

SEQ ID NO: 6587 - DNA, 21 bp, synthetic construct
  misc_feature 1..21: note = n-mer motif encoding polynucleotide
  source 1..21: mol_type = other DNA
gacggcatggtcaggtcgaca

SEQ ID NO: 6588 - DNA, 21 bp, synthetic construct
  misc_feature 1..21: note = n-mer motif encoding polynucleotide
  source 1..21: mol_type = other DNA
aatggtcagctgctggctaat

SEQ ID NO: 6589 - DNA, 21 bp, synthetic construct
  misc_feature 1..21: note = n-mer motif encoding polynucleotide
  source 1..21: mol_type = other DNA
tccgcggggatgacattggac

SEQ ID NO: 6590 - DNA, 21 bp, synthetic construct
  misc_feature 1..21: note = n-mer motif encoding polynucleotide
  source 1..21: mol_type = other DNA
gatcatgtgcatctgacttat

SEQ ID NO: 6591 - DNA, 21 bp, synthetic construct
  misc_feature 1..21: note = n-mer motif encoding polynucleotide
  source 1..21: mol_type = other DNA
acgacactaacgcaaacggac

SEQ ID NO: 6592 - DNA, 21 bp, synthetic construct
  misc_feature 1..21: note = n-mer motif encoding polynucleotide
  source 1..21: mol_type = other DNA
gtgcagttggctgatgggcat

SEQ ID NO: 6593 - DNA, 21 bp, synthetic construct
  misc_feature 1..21: note = n-mer motif encoding polynucleotide
  source 1..21: mol_type = other DNA
actgactcatctgcagactcc

SEQ ID NO: 6594 - DNA, 21 bp, synthetic construct
  misc_feature 1..21: note = n-mer motif encoding polynucleotide
  source 1..21: mol_type = other DNA
gcgatgaatgtgcggagtgat

SEQ ID NO: 6595 - DNA, 21 bp, synthetic construct
  misc_feature 1..21: note = n-mer motif encoding polynucleotide
  source 1..21: mol_type = other DNA
ggtgatatttcttatagggtt

SEQ ID NO: 6596 - DNA, 21 bp, synthetic construct
  misc_feature 1..21: note = n-mer motif encoding polynucleotide
  source 1..21: mol_type = other DNA
atggggtatgttgatagtctg

SEQ ID NO: 6597 - DNA, 21 bp, synthetic construct
  misc_feature 1..21: note = n-mer motif encoding polynucleotide
  source 1..21: mol_type = other DNA
ctttatttggcggcggcttcg

SEQ ID NO: 6598 - DNA, 21 bp, synthetic construct
  misc_feature 1..21: note = n-mer motif encoding polynucleotide
  source 1..21: mol_type = other DNA
tcatccccagactcgtacaga

SEQ ID NO: 6599 - DNA, 21 bp, synthetic construct
  misc_feature 1..21: note = n-mer motif encoding polynucleotide
  source 1..21: mol_type = other DNA
agttataatgtggatctgcat

SEQ ID NO: 6600 - DNA, 21 bp, synthetic construct
  misc_feature 1..21: note = n-mer motif encoding polynucleotide
  source 1..21: mol_type = other DNA
caacacaccgcccaccccatg

SEQ ID NO: 6601 - DNA, 21 bp, synthetic construct
  misc_feature 1..21: note = n-mer motif encoding polynucleotide
  source 1..21: mol_type = other DNA
gcagttatggctacacacccc

SEQ ID NO: 6602 - DNA, 21 bp, synthetic construct
  misc_feature 1..21: note = n-mer motif encoding polynucleotide
  source 1..21: mol_type = other DNA
attagtccgagtgcttctaat

SEQ ID NO: 6603 - DNA, 21 bp, synthetic construct
  misc_feature 1..21: note = n-mer motif encoding polynucleotide
  source 1..21: mol_type = other DNA
actttggataataatcattct

SEQ ID NO: 6604 - DNA, 21 bp, synthetic construct
  misc_feature 1..21: note = n-mer motif encoding polynucleotide
  source 1..21: mol_type = other DNA
agtgggtcttatgtggcgacg

SEQ ID NO: 6605 - DNA, 21 bp, synthetic construct
  misc_feature 1..21: note = n-mer motif encoding polynucleotide
  source 1..21: mol_type = other DNA
atggcggctccgccggagcat

SEQ ID NO: 6606 - DNA, 21 bp, synthetic construct
  misc_feature 1..21: note = n-mer motif encoding polynucleotide
  source 1..21: mol_type = other DNA
cagactgcgtctggtgatact

SEQ ID NO: 6607 - DNA, 21 bp, synthetic construct
  misc_feature 1..21: note = n-mer motif encoding polynucleotide
  source 1..21: mol_type = other DNA
gagtctaagactgtggttatt

SEQ ID NO: 6608 - DNA, 21 bp, synthetic construct
  misc_feature 1..21: note = n-mer motif encoding polynucleotide
  source 1..21: mol_type = other DNA
acggtattaccacaatcagac

SEQ ID NO: 6609 - DNA, 21 bp, synthetic construct
  misc_feature 1..21: note = n-mer motif encoding polynucleotide
  source 1..21: mol_type = other DNA
ccattaaacgcgaacggctcc

SEQ ID NO: 6610 - DNA, 21 bp, synthetic construct
  misc_feature 1..21: note = n-mer motif encoding polynucleotide
  source 1..21: mol_type = other DNA
cccctgaacacaggattaacc

SEQ ID NO: 6611 - DNA, 21 bp, synthetic construct
  misc_feature 1..21: note = n-mer motif encoding polynucleotide
  source 1..21: mol_type = other DNA
gccataacgataataggcact

SEQ ID NO: 6612 - DNA, 21 bp, synthetic construct
  misc_feature 1..21: note = n-mer motif encoding polynucleotide
  source 1..21: mol_type = other DNA
aatcctagtgcgattagttat

SEQ ID NO: 6613 - DNA, 21 bp, synthetic construct
  misc_feature 1..21: note = n-mer motif encoding polynucleotide
  source 1..21: mol_type = other DNA
acagaacacgaaaaatccact

SEQ ID NO: 6614 - DNA, 21 bp, synthetic construct
  misc_feature 1..21: note = n-mer motif encoding polynucleotide
  source 1..21: mol_type = other DNA
gctgagagtcagctggcgtcg

SEQ ID NO: 6615 - DNA, 21 bp, synthetic construct
  misc_feature 1..21: note = n-mer motif encoding polynucleotide
  source 1..21: mol_type = other DNA
gtgcttaagggtacgtttccg

SEQ ID NO: 6616 - DNA, 21 bp, synthetic construct
  misc_feature 1..21: note = n-mer motif encoding polynucleotide
  source 1..21: mol_type = other DNA
tcgttcgccgaaataacgact

SEQ ID NO: 6617 - DNA, 21 bp, synthetic construct
  misc_feature 1..21: note = n-mer motif encoding polynucleotide
  source 1..21: mol_type = other DNA
ccgttaaacggccgcgtaacc

SEQ ID NO: 6618 - DNA, 21 bp, synthetic construct
  misc_feature 1..21: note = n-mer motif encoding polynucleotide
  source 1..21: mol_type = other DNA
tccgaacgcccccaatcgtca

SEQ ID NO: 6619 - DNA, 21 bp, synthetic construct
  misc_feature 1..21: note = n-mer motif encoding polynucleotide
  source 1..21: mol_type = other DNA
gctcagcttcaggattcggtg

SEQ ID NO: 6620 - DNA, 21 bp, synthetic construct
  misc_feature 1..21: note = n-mer motif encoding polynucleotide
  source 1..21: mol_type = other DNA
cccaaccgtgtaacagcaccc

SEQ ID NO: 6621 - DNA, 21 bp, synthetic construct
  misc_feature 1..21: note = n-mer motif encoding polynucleotide
  source 1..21: mol_type = other DNA
gcgcttattgtttcgagtatg

SEQ ID NO: 6622 - DNA, 21 bp, synthetic construct
  misc_feature 1..21: note = n-mer motif encoding polynucleotide
  source 1..21: mol_type = other DNA
gcgcatggtgcttttccggtt

SEQ ID NO: 6623 - DNA, 21 bp, synthetic construct
  misc_feature 1..21: note = n-mer motif encoding polynucleotide
  source 1..21: mol_type = other DNA
gaggcttatcagactgagaag

SEQ ID NO: 6624 - DNA, 21 bp, synthetic construct
  misc_feature 1..21: note = n-mer motif encoding polynucleotide
  source 1..21: mol_type = other DNA
gctgcggcttcgcctttggct

SEQ ID NO: 6625 - DNA, 21 bp, synthetic construct
  misc_feature 1..21: note = n-mer motif encoding polynucleotide
  source 1..21: mol_type = other DNA
ccccaagccactctcaacaac

SEQ ID NO: 6626 - DNA, 21 bp, synthetic construct
  misc_feature 1..21: note = n-mer motif encoding polynucleotide
  source 1..21: mol_type = other DNA
acgaggggtgatatggagttt

SEQ ID NO: 6627 - DNA, 21 bp, synthetic construct
  misc_feature 1..21: note = n-mer motif encoding polynucleotide
  source 1..21: mol_type = other DNA
agcaacctaggcgaagcatct

SEQ ID NO: 6628 - DNA, 21 bp, synthetic construct
  misc_feature 1..21: note = n-mer motif encoding polynucleotide
  source 1..21: mol_type = other DNA
ggaatcaccggaagccccggc

SEQ ID NO: 6629 - DNA, 21 bp, synthetic construct
  misc_feature 1..21: note = n-mer motif encoding polynucleotide
  source 1..21: mol_type = other DNA
gggtttgagacgagtagtcct

SEQ ID NO: 6630 - DNA, 21 bp, synthetic construct
  misc_feature 1..21: note = n-mer motif encoding polynucleotide
  source 1..21: mol_type = other DNA
cccgcgagaagcgacgccctt

SEQ ID NO: 6631 - DNA, 21 bp, synthetic construct
  misc_feature 1..21: note = n-mer motif encoding polynucleotide
  source 1..21: mol_type = other DNA
catgctaattatgttgaggtg

SEQ ID NO: 6632 - DNA, 21 bp, synthetic construct
  misc_feature 1..21: note = n-mer motif encoding polynucleotide
  source 1..21: mol_type = other DNA
gtgactcgtagtacgaaggag

SEQ ID NO: 6633 - DNA, 21 bp, synthetic construct
  misc_feature 1..21: note = n-mer motif encoding polynucleotide
  source 1..21: mol_type = other DNA
gatgttgcgttgaggtcgaat

SEQ ID NO: 6634 - DNA, 21 bp, synthetic construct
  misc_feature 1..21: note = n-mer motif encoding polynucleotide
  source 1..21: mol_type = other DNA
gagtctgatttgcgtcagcgg

SEQ ID NO: 6635 - DNA, 21 bp, synthetic construct
  misc_feature 1..21: note = n-mer motif encoding polynucleotide
  source 1..21: mol_type = other DNA
ccgttactcgcagcgaacccg

SEQ ID NO: 6636 - DNA, 21 bp, synthetic construct
  misc_feature 1..21: note = n-mer motif encoding polynucleotide
  source 1..21: mol_type = other DNA
ataaacgccgcgcacaggccc

SEQ ID NO: 6637 - DNA, 21 bp, synthetic construct
  misc_feature 1..21: note = n-mer motif encoding polynucleotide
  source 1..21: mol_type = other DNA
gctcggagagacgtaaactcg

SEQ ID NO: 6638 - DNA, 21 bp, synthetic construct
  misc_feature 1..21: note = n-mer motif encoding polynucleotide
  source 1..21: mol_type = other DNA
agtatggataaggtggagaag

SEQ ID NO: 6639 - DNA, 21 bp, synthetic construct
  misc_feature 1..21: note = n-mer motif encoding polynucleotide
  source 1..21: mol_type = other DNA
aacgtcagcgcacgggaaaca

SEQ ID NO: 6640 - DNA, 21 bp, synthetic construct
  misc_feature 1..21: note = n-mer motif encoding polynucleotide
  source 1..21: mol_type = other DNA
ctgacgacggctggtatgtgg

SEQ ID NO: 6641 - DNA, 21 bp, synthetic construct
  misc_feature 1..21: note = n-mer motif encoding polynucleotide
  source 1..21: mol_type = other DNA
gcgcgggcagaaggggtcttc

SEQ ID NO: 6642 - DNA, 21 bp, synthetic construct
  misc_feature 1..21: note = n-mer motif encoding polynucleotide
  source 1..21: mol_type = other DNA
ccgagtgatcatatgcggact

SEQ ID NO: 6643 - DNA, 21 bp, synthetic construct
  misc_feature 1..21: note = n-mer motif encoding polynucleotide
  source 1..21: mol_type = other DNA
agtaggacggttattttgtcg

SEQ ID NO: 6644 - DNA, 21 bp, synthetic construct
  misc_feature 1..21: note = n-mer motif encoding polynucleotide
  source 1..21: mol_type = other DNA
cagagtaatgctgctgagggt

SEQ ID NO: 6645 - DNA, 21 bp, synthetic construct
  misc_feature 1..21: note = n-mer motif encoding polynucleotide
  source 1..21: mol_type = other DNA
tggaccgaaacggccgctcac

SEQ ID NO: 6646 - DNA, 21 bp, synthetic construct
  misc_feature 1..21: note = n-mer motif encoding polynucleotide
  source 1..21: mol_type = other DNA
aaggagaatcagcttagtaag

SEQ ID NO: 6647 - protein, 7 aa, synthetic construct
  REGION 1..7: note = n-mer motif
RGDLSTP

SEQ ID NO: 6648 - protein, 7 aa, synthetic construct
  REGION 1..7: note = n-mer motif
RGDLSTP

SEQ ID NO: 6649 - protein, 7 aa, synthetic construct
  REGION 1..7: note = n-mer motif
RGDLTTP

SEQ ID NO: 6650 - protein, 7 aa, synthetic construct
  REGION 1..7: note = n-mer motif
RGDLNQY

SEQ ID NO: 6651 - protein, 7 aa, synthetic construct
  REGION 1..7: note = n-mer motif
RGDQLYH

SEQ ID NO: 6652 - protein, 7 aa, synthetic construct
  REGION 1..7: note = n-mer motif
RGDATEL

SEQ ID NO: 6653 - protein, 7 aa, synthetic construct
  REGION 1..7: note = n-mer motif
RGDTMSK

SEQ ID NO: 6654 - protein, 7 aa, synthetic construct
  REGION 1..7: note = n-mer motif
RGDLNQY

SEQ ID NO: 6655 - protein, 7 aa, synthetic construct
  REGION 1..7: note = n-mer motif
RGDLTTP

SEQ ID NO: 6656 - protein, 7 aa, synthetic construct
  REGION 1..7: note = n-mer motif
RGDMINT

SEQ ID NO: 6657 - protein, 7 aa, synthetic construct
  REGION 1..7: note = n-mer motif
RGDTMSK

SEQ ID NO: 6658 - protein, 7 aa, synthetic construct
  REGION 1..7: note = n-mer motif
RGDTMNY

SEQ ID NO: 6659 - protein, 7 aa, synthetic construct
  REGION 1..7: note = n-mer motif
RGDATEL

SEQ ID NO: 6660 - protein, 7 aa, synthetic construct
  REGION 1..7: note = n-mer motif
RLDLQVH

SEQ ID NO: 6661 - protein, 7 aa, synthetic construct
  REGION 1..7: note = n-mer motif
RGDVAAK

SEQ ID NO: 6662 - protein, 7 aa, synthetic construct
  REGION 1..7: note = n-mer motif
RGDLNDS

SEQ ID NO: 6663 - protein, 7 aa, synthetic construct
  REGION 1..7: note = n-mer motif
RGDLNDS

SEQ ID NO: 6664 - protein, 7 aa, synthetic construct
  REGION 1..7: note = n-mer motif
SYGNTHD

SEQ ID NO: 6665 - protein, 7 aa, synthetic construct
  REGION 1..7: note = n-mer motif
RLDLQVN

SEQ ID NO: 6666 - protein, 7 aa, synthetic construct
  REGION 1..7: note = n-mer motif
KAGQLVE

SEQ ID NO: 6667 - protein, 7 aa, synthetic construct
  REGION 1..7: note = n-mer motif
DQTASIV

SEQ ID NO: 6668 - protein, 7 aa, synthetic construct
  REGION 1..7: note = n-mer motif
YIAAGEQ

SEQ ID NO: 6669 - protein, 7 aa, synthetic construct
  REGION 1..7: note = n-mer motif
AVVLNSN

SEQ ID NO: 6670 - protein, 7 aa, synthetic construct
  REGION 1..7: note = n-mer motif
SKGNEQM

SEQ ID NO: 6671 - protein, 7 aa, synthetic construct
  REGION 1..7: note = n-mer motif
ANPNILD

SEQ ID NO: 6672 - protein, 7 aa, synthetic construct
  REGION 1..7: note = n-mer motif
HNKPNGD

SEQ ID NO: 6673 - protein, 7 aa, synthetic construct
  REGION 1..7: note = n-mer motif
DKTEMLQ

SEQ ID NO: 6674 - protein, 7 aa, synthetic construct
  REGION 1..7: note = n-mer motif
TEQSYSR

SEQ ID NO: 6675 - protein, 7 aa, synthetic construct
  REGION 1..7: note = n-mer motif
TVMMSTR

SEQ ID NO: 6676 - protein, 7 aa, synthetic construct
  REGION 1..7: note = n-mer motif
VSTYLLA

SEQ ID NO: 6677 - protein, 7 aa, synthetic construct
  REGION 1..7: note = n-mer motif
PNVTQSY

SEQ ID NO: 6678 - protein, 7 aa, synthetic construct
  REGION 1..7: note = n-mer motif
MSNLGYE

SEQ ID NO: 6679 - protein, 7 aa, synthetic construct
  REGION 1..7: note = n-mer motif
TMGANGT

SEQ ID NO: 6680 - protein, 7 aa, synthetic construct
  REGION 1..7: note = n-mer motif
NVNAQSR

SEQ ID NO: 6681 - protein, 7 aa, synthetic construct
  REGION 1..7: note = n-mer motif
DQNFERR

SEQ ID NO: 6682 - protein, 7 aa, synthetic construct
  REGION 1..7: note = n-mer motif
NTYTPGK

SEQ ID NO: 6683 - protein, 7 aa, synthetic construct
  REGION 1..7: note = n-mer motif
RGDMINT

SEQ ID NO: 6684 - protein, 7 aa, synthetic construct
  REGION 1..7: note = n-mer motif
AQFESGR

SEQ ID NO: 6685 - protein, 7 aa, synthetic construct
  REGION 1..7: note = n-mer motif
TAYQAGL

SEQ ID NO: 6686 - protein, 7 aa, synthetic construct
  REGION 1..7: note = n-mer motif
SVSSVVL

SEQ ID NO: 6687 - protein, 7 aa, synthetic construct
  REGION 1..7: note = n-mer motif
GLSKASD

SEQ ID NO: 6688 - protein, 7 aa, synthetic construct
  REGION 1..7: note = n-mer motif
WNGNATQ

SEQ ID NO: 6689 - protein, 7 aa, synthetic construct
  REGION 1..7: note = n-mer motif
TAGGERA

SEQ ID NO: 6690 - protein, 7 aa, synthetic construct
  REGION 1..7: note = n-mer motif
YTSQTST

SEQ ID NO: 6691 - protein, 7 aa, synthetic construct
  REGION 1..7: note = n-mer motif
ANIENTS

SEQ ID NO: 6692 - protein, 7 aa, synthetic construct
  REGION 1..7: note = n-mer motif
ELSVPKP

SEQ ID NO: 6693 - protein, 7 aa, synthetic construct
  REGION 1..7: note = n-mer motif
DPGRTGT

SEQ ID NO: 6694 - protein, 7 aa, synthetic construct
  REGION 1..7: note = n-mer motif
DRPNNMT

SEQ ID NO: 6695 - protein, 7 aa, synthetic construct
  REGION 1..7: note = n-mer motif
YSTDLRM

SEQ ID NO: 6696 - protein, 7 aa, synthetic construct
  REGION 1..7: note = n-mer motif
QSVNSTS

SEQ ID NO: 6697 - protein, 7 aa, synthetic construct
  REGION 1..7: note = n-mer motif
AAQLVSP

SEQ ID NO: 6698 - protein, 7 aa, synthetic construct
  REGION 1..7: note = n-mer motif
LGGNSRF

SEQ ID NO: 6699 - protein, 7 aa, synthetic construct
  REGION 1..7: note = n-mer motif
ATLNNSY

SEQ ID NO: 6700 - protein, 7 aa, synthetic construct
  REGION 1..7: note = n-mer motif
RLDVGSP

SEQ ID NO: 6701 - protein, 7 aa, synthetic construct
  REGION 1..7: note = n-mer motif
YRGREDW

SEQ ID NO: 6702 - protein, 7 aa, synthetic construct
  REGION 1..7: note = n-mer motif
RGDLSTP

SEQ ID NO: 6703 - protein, 7 aa, synthetic construct
  REGION 1..7: note = n-mer motif
SGLSHGQ

SEQ ID NO: 6704 - protein, 7 aa, synthetic construct
  REGION 1..7: note = n-mer motif
EHATAKQ

SEQ ID NO: 6705 - protein, 7 aa, synthetic construct
  REGION 1..7: note = n-mer motif
GAEAGRQ

SEQ ID NO: 6706 - protein, 7 aa, synthetic construct
  REGION 1..7: note = n-mer motif
ISGSTTH

SEQ ID NO: 6707 - protein, 7 aa, synthetic construct
  REGION 1..7: note = n-mer motif
GTVVPGS

SEQ ID NO: 6708 - protein, 7 aa, synthetic construct
  REGION 1..7: note = n-mer motif
HNNNMLN

SEQ ID NO: 6709 - protein, 7 aa, synthetic construct
  REGION 1..7: note = n-mer motif
RLTDTMH

SEQ ID NO: 6710 - protein, 7 aa, synthetic construct
  REGION 1..7: note = n-mer motif
NTYPFNA

SEQ ID NO: 6711 - protein, 7 aa, synthetic construct
  REGION 1..7: note = n-mer motif
STTTGHM

SEQ ID NO: 6712 - protein, 7 aa, synthetic construct
  REGION 1..7: note = n-mer motif
VHNPTTT

SEQ ID NO: 6713 - protein, 7 aa, synthetic construct
  REGION 1..7: note = n-mer motif
NLQVNAN

SEQ ID NO: 6714 - protein, 7 aa, synthetic construct
  REGION 1..7: note = n-mer motif
RYGESIE

SEQ ID NO: 6715 - protein, 7 aa, synthetic construct
  REGION 1..7: note = n-mer motif
NTTPPNH

SEQ ID NO: 6716 - protein, 7 aa, synthetic construct
  REGION 1..7: note = n-mer motif
NTLQNSH

SEQ ID NO: 6717 - protein, 7 aa, synthetic construct
  REGION 1..7: note = n-mer motif
SLNNMGS

SEQ ID NO: 6718 - protein, 7 aa, synthetic construct
  REGION 1..7: note = n-mer motif
RNENVNA

SEQ ID NO: 6719 - protein, 7 aa, synthetic construct
  REGION 1..7: note = n-mer motif
AVHATSS

SEQ ID NO: 6720 - protein, 7 aa, synthetic construct
  REGION 1..7: note = n-mer motif
TQHLPST

SEQ ID NO: 6721 - protein, 7 aa, synthetic construct
  REGION 1..7: note = n-mer motif
SVLSQAN

SEQ ID NO: 6722 - protein, 7 aa, synthetic construct
  REGION 1..7: note = n-mer motif
SSSTEGQ

SEQ ID NO: 6723 - protein, 7 aa, synthetic construct
  REGION 1..7: note = n-mer motif
GRTDTPN

SEQ ID NO: 6724 - protein, 7 aa, synthetic construct
  REGION 1..7: note = n-mer motif
VQTHIGV

SEQ ID NO: 6725 - protein, 7 aa, synthetic construct
  REGION 1..7: note = n-mer motif
TSASENW

SEQ ID NO: 6726 - protein, 7 aa, synthetic construct
  REGION 1..7: note = n-mer motif
GKANDGS

SEQ ID NO: 6727 - protein, 7 aa, synthetic construct
  REGION 1..7: note = n-mer motif
VERNTDM

SEQ ID NO: 6728 - protein, 7 aa, synthetic construct
  REGION 1..7: note = n-mer motif
QNHASGE

SEQ ID NO: 6729 - protein, 7 aa, synthetic construct
  REGION 1..7: note = n-mer motif
YYEKLSA

SEQ ID NO: 6730 - protein, 7 aa, synthetic construct
  REGION 1..7: note = n-mer motif
FIANTNP

SEQ ID NO: 6731 - protein, 7 aa, synthetic construct
  REGION 1..7: note = n-mer motif
TSTASKQ

SEQ ID NO: 6732 - protein, 7 aa, synthetic construct
  REGION 1..7: note = n-mer motif
NNDNGFV

SEQ ID NO: 6733 - protein, 7 aa, synthetic construct
  REGION 1..7: note = n-mer motif
ANSIGGP

SEQ ID NO: 6734 - protein, 7 aa, synthetic construct
  REGION 1..7: note = n-mer motif
TGQLVGT

SEQ ID NO: 6735 - protein, 7 aa, synthetic construct
  REGION 1..7: note = n-mer motif
YSQSLSE

SEQ ID NO: 6736 - protein, 7 aa, synthetic construct
  REGION 1..7: note = n-mer motif
VYNGNVV

SEQ ID NO: 6737 - protein, 7 aa, synthetic construct
  REGION 1..7: note = n-mer motif
NSAESSR

SEQ ID NO: 6738 - protein, 7 aa, synthetic construct
  REGION 1..7: note = n-mer motif
TRNLSES

SEQ ID NO: 6739 - protein, 7 aa, synthetic construct
  REGION 1..7: note = n-mer motif
SMSDGLR

SEQ ID NO: 6740 - protein, 7 aa, synthetic construct
  REGION 1..7: note = n-mer motif
VGDQSRP

SEQ ID NO: 6741 - protein, 7 aa, synthetic construct
  REGION 1..7: note = n-mer motif
FTVNQDL

SEQ ID NO: 6742 - protein, 7 aa, synthetic construct
  REGION 1..7: note = n-mer motif
YHKYSTD

SEQ ID NO: 6743 - protein, 7 aa, synthetic construct
  REGION 1..7: note = n-mer motif
YGVQANS

SEQ ID NO: 6744 - protein, 7 aa, synthetic construct
  REGION 1..7: note = n-mer motif
LQTPGTT

SEQ ID NO: 6745 - protein, 7 aa, synthetic construct
  REGION 1..7: note = n-mer motif
YQQTSST

SEQ ID NO: 6746 - protein, 7 aa, synthetic construct
  REGION 1..7: note = n-mer motif
QTNTNDR

SEQ ID NO: 6747 - protein, 7 aa, synthetic construct
  REGION 1..7: note = n-mer motif
MDKSNNS

SEQ ID NO: 6748 - protein, 7 aa, synthetic construct
  REGION 1..7: note = n-mer motif
HLSQANH

SEQ ID NO: 6749 - protein, 7 aa, synthetic construct
  REGION 1..7: note = n-mer motif
VGASTAS

SEQ ID NO: 6750 - protein, 7 aa, synthetic construct
  REGION 1..7: note = n-mer motif
HNNNLQN

SEQ ID NO: 6751 - protein, 7 aa, synthetic construct
  REGION 1..7: note = n-mer motif
STYGNTY

SEQ ID NO: 6752 - protein, 7 aa, synthetic construct
  REGION 1..7: note = n-mer motif
RADVSWS

SEQ ID NO: 6753 - protein, 7 aa, synthetic construct
  REGION 1..7: note = n-mer motif
RGDNSTP

SEQ ID NO: 6754 - protein, 7 aa, synthetic construct
  REGION 1..7: note = n-mer motif
GRDYAMS

SEQ ID NO: 6755 - protein, 7 aa, synthetic construct
  REGION 1..7: note = n-mer motif
PNNEKNP

SEQ ID NO: 6756 - protein, 7 aa, synthetic construct
  REGION 1..7: note = n-mer motif
DNVNSQP

SEQ ID NO: 6757 - protein, 7 aa, synthetic construct
  REGION 1..7: note = n-mer motif
MGTEYRM

SEQ ID NO: 6758 - protein, 7 aa, synthetic construct
  REGION 1..7: note = n-mer motif
NQSINNI

SEQ ID NO: 6759 - protein, 7 aa, synthetic construct
  REGION 1..7: note = n-mer motif
AIDSIKQ

SEQ ID NO: 6760 - protein, 7 aa, synthetic construct
  REGION 1..7: note = n-mer motif
VESSYSR

SEQ ID NO: 6761 - protein, 7 aa, synthetic construct
  REGION 1..7: note = n-mer motif
GQYSQTL

SEQ ID NO: 6762 - protein, 7 aa, synthetic construct
  REGION 1..7: note = n-mer motif
TIQDHIK

SEQ ID NO: 6763 - protein, 7 aa, synthetic construct
  REGION 1..7: note = n-mer motif
NSSQWPN

SEQ ID NO: 6764 - protein, 7 aa, synthetic construct
  REGION 1..7: note = n-mer motif
TDNGLLV

SEQ ID NO: 6765 - protein, 7 aa, synthetic construct
  REGION 1..7: note = n-mer motif
VRETTHL

SEQ ID NO: 6766 - protein, 7 aa, synthetic construct
  REGION 1..7: note = n-mer motif
RGDMTRA

SEQ ID NO: 6767 - protein, 7 aa, synthetic construct
  REGION 1..7: note = n-mer motif
TYGITHD

SEQ ID NO: 6768 - protein, 7 aa, synthetic construct
  REGION 1..7: note = n-mer motif
TALNTYP

SEQ ID NO: 6769 - protein, 7 aa, synthetic construct
  REGION 1..7: note = n-mer motif
GGENRTP

SEQ ID NO: 6770 - protein, 7 aa, synthetic construct
  REGION 1..7: note = n-mer motif
YLQEKFP

SEQ ID NO: 6771 - protein, 7 aa, synthetic construct
  REGION 1..7: note = n-mer motif
LNLTNHN

SEQ ID NO: 6772 - protein, 7 aa, synthetic construct
  REGION 1..7: note = n-mer motif
GLASLHL

SEQ ID NO: 6773 - protein, 7 aa, synthetic construct
  REGION 1..7: note = n-mer motif
VEHVAHQ

SEQ ID NO: 6774 - protein, 7 aa, synthetic construct
  REGION 1..7: note = n-mer motif
SEHHAGI

SEQ ID NO: 6775 - protein, 7 aa, synthetic construct
  REGION 1..7: note = n-mer motif
EASNYER

SEQ ID NO: 6776 - protein, 7 aa, synthetic construct
  REGION 1..7: note = n-mer motif
PSNSERF

SEQ ID NO: 6777 - protein, 7 aa, synthetic construct
  REGION 1..7: note = n-mer motif
SPGNGLL

SEQ ID NO: 6778 - protein, 7 aa, synthetic construct
  REGION 1..7: note = n-mer motif
ILKSDAP

SEQ ID NO: 6779 - protein, 7 aa, synthetic construct
  REGION 1..7: note = n-mer motif
FDSANGR

SEQ ID NO: 6780 - protein, 7 aa, synthetic construct
  REGION 1..7: note = n-mer motif
DGKTTSN

SEQ ID NO: 6781 - protein, 7 aa, synthetic construct
  REGION 1..7: note = n-mer motif
TNYPEAN

SEQ ID NO: 6782 - protein, 7 aa, synthetic construct
  REGION 1..7: note = n-mer motif
RGDHSTP

SEQ ID NO: 6783 - protein, 7 aa, synthetic construct
  REGION 1..7: note = n-mer motif
QTTILAA

SEQ ID NO: 6784 - protein, 7 aa, synthetic construct
  REGION 1..7: note = n-mer motif
ATAHQDG

SEQ ID NO: 6785 - protein, 7 aa, synthetic construct
  REGION 1..7: note = n-mer motif
QALATTN

SEQ ID NO: 6786 - protein, 7 aa, synthetic construct
  REGION 1..7: note = n-mer motif
YNATPSQ

SEQ ID NO: 6787 - protein, 7 aa, synthetic construct
  REGION 1..7: note = n-mer motif
ELSTPMV

SEQ ID NO: 6788 - protein, 7 aa, synthetic construct
  REGION 1..7: note = n-mer motif
INISSDF

SEQ ID NO: 6789 - protein, 7 aa, synthetic construct
  REGION 1..7: note = n-mer motif
VTAHQLS

SEQ ID NO: 6790 - protein, 7 aa, synthetic construct
  REGION 1..7: note = n-mer motif
GESSSIS

SEQ ID NO: 6791 - protein, 7 aa, synthetic construct
  REGION 1..7: note = n-mer motif
ESLPISK

SEQ ID NO: 6792 - protein, 7 aa, synthetic construct
  REGION 1..7: note = n-mer motif
TNVSTLL

SEQ ID NO: 6793 - protein, 7 aa, synthetic construct
  REGION 1..7: note = n-mer motif
WQTNGMQ

SEQ ID NO: 6794 - protein, 7 aa, synthetic construct
  REGION 1..7: note = n-mer motif
YRMETNP

SEQ ID NO: 6795 - protein, 7 aa, synthetic construct
  REGION 1..7: note = n-mer motif
ITGNTVG

SEQ ID NO: 6796 - protein, 7 aa, synthetic construct
  REGION 1..7: note = n-mer motif
LNTLIHK

SEQ ID NO: 6797 - protein, 7 aa, synthetic construct
  REGION 1..7: note = n-mer motif
GTSLENR

SEQ ID NO: 6798 - protein, 7 aa, synthetic construct
  REGION 1..7: note = n-mer motif
YQHNQAH

SEQ ID NO: 6799 - protein, 7 aa, synthetic construct
  REGION 1..7: note = n-mer motif
IESKTVQ

SEQ ID NO: 6800 - protein, 7 aa, synthetic construct
  REGION 1..7: note = n-mer motif
YTQGIMN

SEQ ID NO: 6801 - protein, 7 aa, synthetic construct
  REGION 1..7: note = n-mer motif
STNEAPK

SEQ ID NO: 6802 - protein, 7 aa, synthetic construct
  REGION 1..7: note = n-mer motif
LSQNFNP

SEQ ID NO: 6803 - protein, 7 aa, synthetic construct
  REGION 1..7: note = n-mer motif
YSSEMSE

SEQ ID NO: 6804 - protein, 7 aa, synthetic construct
  REGION 1..7: note = n-mer motif
SYGGSGP

SEQ ID NO: 6805 - protein, 7 aa, synthetic construct
  REGION 1..7: note = n-mer motif
MDAAYGS

SEQ ID NO: 6806 - protein, 7 aa, synthetic construct
  REGION 1..7: note = n-mer motif
PFNPGNV

SEQ ID NO: 6807 - protein, 7 aa, synthetic construct
  REGION 1..7: note = n-mer motif
QKSETYT

SEQ ID NO: 6808 - protein, 7 aa, synthetic construct
  REGION 1..7: note = n-mer motif
NKDHNHL

SEQ ID NO: 6809 - protein, 7 aa, synthetic construct
  REGION 1..7: note = n-mer motif
LTGSDMK

SEQ ID NO: 6810 - protein, 7 aa, synthetic construct
  REGION 1..7: note = n-mer motif
SKDSTMY

SEQ ID NO: 6811 - protein, 7 aa, synthetic construct
  REGION 1..7: note = n-mer motif
EAFPRAG

SEQ ID NO: 6812 - protein, 7 aa, synthetic construct
  REGION 1..7: note = n-mer motif
EHTHLNP

SEQ ID NO: 6813 - protein, 7 aa, synthetic construct
  REGION 1..7: note = n-mer motif
SSDPKGQ

SEQ ID NO: 6814 - protein, 7 aa, synthetic construct
  REGION 1..7: note = n-mer motif
KTIDIAQ

SEQ ID NO: 6815 - protein, 7 aa, synthetic construct
  REGION 1..7: note = n-mer motif
TGSLNSM

SEQ ID NO: 6816 - protein, 7 aa, synthetic construct
  REGION 1..7: note = n-mer motif
MQREDAN

SEQ ID NO: 6817 - protein, 7 aa, synthetic construct
  REGION 1..7: note = n-mer motif
ASTVSLY

SEQ ID NO: 6818 - protein, 7 aa, synthetic construct
  REGION 1..7: note = n-mer motif
GRDDLTN

SEQ ID NO: 6819 - protein, 7 aa, synthetic construct
  REGION 1..7: note = n-mer motif
SNPGNHN

SEQ ID NO: 6820 - protein, 7 aa, synthetic construct
  REGION 1..7: note = n-mer motif
DTYKGKW

SEQ ID NO: 6821 - protein, 7 aa, synthetic construct
  REGION 1..7: note = n-mer motif
PPNGSSR

SEQ ID NO: 6822 - protein, 7 aa, synthetic construct
  REGION 1..7: note = n-mer motif
ASYSISD

SEQ ID NO: 6823 - protein, 7 aa, synthetic construct
  REGION 1..7: note = n-mer motif
VTVSLDG

SEQ ID NO: 6824 - protein, 7 aa, synthetic construct
  REGION 1..7: note = n-mer motif
MAIGHSP

SEQ ID NO: 6825 - protein, 7 aa, synthetic construct
  REGION 1..7: note = n-mer motif
FRTVYTG

SEQ ID NO: 6826 - protein, 7 aa, synthetic construct
  REGION 1..7: note = n-mer motif
KKRQPIA

SEQ ID NO: 6827 - protein, 7 aa, synthetic construct
  REGION 1..7: note = n-mer motif
KNKLYYG

SEQ ID NO: 6828 - protein, 7 aa, synthetic construct
  REGION 1..7: note = n-mer motif
STSPVNS

SEQ ID NO: 6829 - protein, 7 aa, synthetic construct
  REGION 1..7: note = n-mer motif
GSGIAGT

SEQ ID NO: 6830 - protein, 7 aa, synthetic construct
  REGION 1..7: note = n-mer motif
IDVLNGS

SEQ ID NO: 6831 - protein, 7 aa, synthetic construct
  REGION 1..7: note = n-mer motif
GHNMAQA

SEQ ID NO: 6832 - protein, 7 aa, synthetic construct
  REGION 1..7: note = n-mer motif
TRSNSDE

SEQ ID NO: 6833 - protein, 7 aa, synthetic construct
  REGION 1..7: note = n-mer motif
GAKGTMG

SEQ ID NO: 6834 - protein, 7 aa, synthetic construct
  REGION 1..7: note = n-mer motif
ATTLTGD

SEQ ID NO: 6835 - protein, 7 aa, synthetic construct
  REGION 1..7: note = n-mer motif
FNTSSEF

SEQ ID NO: 6836 - protein, 7 aa, synthetic construct
  REGION 1..7: note = n-mer motif
YTAQTGW

SEQ ID NO: 6837 - protein, 7 aa, synthetic construct
  REGION 1..7: note = n-mer motif
RVNNDAI

SEQ ID NO: 6838 - protein, 7 aa, synthetic construct
  REGION 1..7: note = n-mer motif
TIQLTDT

SEQ ID NO: 6839 - protein, 7 aa, synthetic construct
  REGION 1..7: note = n-mer motif
ASMPSVD

SEQ ID NO: 6840 - protein, 7 aa, synthetic construct
  REGION 1..7: note = n-mer motif
NQVGASA

SEQ ID NO: 6841 - protein, 7 aa, synthetic construct
  REGION 1..7: note = n-mer motif
GNMVTPN

SEQ ID NO: 6842 - protein, 7 aa, synthetic construct
  REGION 1..7: note = n-mer motif
RGDQGTH

SEQ ID NO: 6843 - protein, 7 aa, synthetic construct
  REGION 1..7: note = n-mer motif
SSDSRIP

SEQ ID NO: 6844 - protein, 7 aa, synthetic construct
  REGION 1..7: note = n-mer motif
GLHGTNA

SEQ ID NO: 6845 - protein, 7 aa, synthetic construct
  REGION 1..7: note = n-mer motif
SSYQSGL

SEQ ID NO: 6846 - protein, 7 aa, synthetic construct
  REGION 1..7: note = n-mer motif
TAYSPTV

SEQ ID NO: 6847 - protein, 7 aa, synthetic construct
  REGION 1..7: note = n-mer motif
RSDTTNA

SEQ ID NO: 6848 - protein, 7 aa, synthetic construct
  REGION 1..7: note = n-mer motif
RIVANEQ

SEQ ID NO: 6849 - protein, 7 aa, synthetic construct
  REGION 1..7: note = n-mer motif
IHNESYV

SEQ ID NO: 6850 - protein, 7 aa, synthetic construct
  REGION 1..7: note = n-mer motif
QQNTRLP

SEQ ID NO: 6851 - protein, 7 aa, synthetic construct
  REGION 1..7: note = n-mer motif
GINSSHF

SEQ ID NO: 6852 - protein, 7 aa, synthetic construct
  REGION 1..7: note = n-mer motif
GMTSNQV

SEQ ID NO: 6853 - protein, 7 aa, synthetic construct
  REGION 1..7: note = n-mer motif
REIVHSN

SEQ ID NO: 6854 - protein, 7 aa, synthetic construct
  REGION 1..7: note = n-mer motif
AEHTYTV

SEQ ID NO: 6855 - protein, 7 aa, synthetic construct
  REGION 1..7: note = n-mer motif
PATLHLT

SEQ ID NO: 6856 - protein, 7 aa, synthetic construct
  REGION 1..7: note = n-mer motif
KQTDSRG

SEQ ID NO: 6857 - protein, 7 aa, synthetic construct
  REGION 1..7: note = n-mer motif
TMVEVLP

SEQ ID NO: 6858 - protein, 7 aa, synthetic construct
  REGION 1..7: note = n-mer motif
IPTGQTS

SEQ ID NO: 6859 - protein, 7 aa, synthetic construct
  REGION 1..7: note = n-mer motif
MIKTNML

SEQ ID NO: 6860 - protein, 7 aa, synthetic construct
  REGION 1..7: note = n-mer motif
AERPTRD

SEQ ID NO: 6861 - protein, 7 aa, synthetic construct
  REGION 1..7: note = n-mer motif
RDLGQTG

SEQ ID NO: 6862 - protein, 7 aa, synthetic construct
  REGION 1..7: note = n-mer motif
NEGRVQT

SEQ ID NO: 6863 - protein, 7 aa, synthetic construct
  REGION 1..7: note = n-mer motif
TAASTAR

SEQ ID NO: 6864 - protein, 7 aa, synthetic construct
  REGION 1..7: note = n-mer motif
TQGNNMV

SEQ ID NO: 6865 - protein, 7 aa, synthetic construct
  REGION 1..7: note = n-mer motif
HSTFPTT

SEQ ID NO: 6866 - protein, 7 aa, synthetic construct
  REGION 1..7: note = n-mer motif
QSIGHPV

SEQ ID NO: 6867 - protein, 7 aa, synthetic construct
  REGION 1..7: note = n-mer motif
SGVNSER

SEQ ID NO: 6868 - protein, 7 aa, synthetic construct
  REGION 1..7: note = n-mer motif
PHANGVT

SEQ ID NO: 6869 - protein, 7 aa, synthetic construct
  REGION 1..7: note = n-mer motif
DHQQALA

SEQ ID NO: 6870 - protein, 7 aa, synthetic construct
  REGION 1..7: note = n-mer motif
SQQGFTL

SEQ ID NO: 6871 - protein, 7 aa, synthetic construct
  REGION 1..7: note = n-mer motif
TNAALVP

SEQ ID NO: 6872 - protein, 7 aa, synthetic construct
  REGION 1..7: note = n-mer motif
GVSSNSA

SEQ ID NO: 6873 - protein, 7 aa, synthetic construct
  REGION 1..7: note = n-mer motif
HDTVGER

SEQ ID NO: 6874 - protein, 7 aa, synthetic construct
  REGION 1..7: note = n-mer motif
ALNAQGI

SEQ ID NO: 6875 - protein, 7 aa, synthetic construct
  REGION 1..7: note = n-mer motif
HDSMCCA

SEQ ID NO: 6876 - protein, 7 aa, synthetic construct
  REGION 1..7: note = n-mer motif
YIAAGEQ

SEQ ID NO: 6877 - protein, 7 aa, synthetic construct
  REGION 1..7: note = n-mer motif
ENAREGV

SEQ ID NO: 6878 - protein, 7 aa, synthetic construct
  REGION 1..7: note = n-mer motif
ATVYNEL

SEQ ID NO: 6879 - protein, 7 aa, synthetic construct
  REGION 1..7: note = n-mer motif
DTNGIKS

SEQ ID NO: 6880 - protein, 7 aa, synthetic construct
  REGION 1..7: note = n-mer motif
KPTANDW

SEQ ID NO: 6881 - protein, 7 aa, synthetic construct
  REGION 1..7: note = n-mer motif
YESTHVN

SEQ ID NO: 6882 - protein, 7 aa, synthetic construct
  REGION 1..7: note = n-mer motif
YTNGGHL

SEQ ID NO: 6883 - protein, 7 aa, synthetic construct
  REGION 1..7: note = n-mer motif
VDKSSPV

SEQ ID NO: 6884 - protein, 7 aa, synthetic construct
  REGION 1..7: note = n-mer motif
PIQNESS

SEQ ID NO: 6885 - protein, 7 aa, synthetic construct
  REGION 1..7: note = n-mer motif
IHKSSVE

SEQ ID NO: 6886 - protein, 7 aa, synthetic construct
  REGION 1..7: note = n-mer motif
HDISLDR

SEQ ID NO: 6887 - protein, 6 aa, synthetic construct
  REGION 1..6: note = n-mer motif
WGAEFA

SEQ ID NO: 6888 - protein, 7 aa, synthetic construct
  REGION 1..7: note = n-mer motif
YSQSIKN

SEQ ID NO: 6889 - protein, 7 aa, synthetic construct
  REGION 1..7: note = n-mer motif
AQDNNHD

SEQ ID NO: 6890 - protein, 7 aa, synthetic construct
  REGION 1..7: note = n-mer motif
GQKETTA

SEQ ID NO: 6891 - protein, 7 aa, synthetic construct
  REGION 1..7: note = n-mer motif
KSEVPAR

SEQ ID NO: 6892 - protein, 7 aa, synthetic construct
  REGION 1..7: note = n-mer motif
ELNTAHA

SEQ ID NO: 6893 - protein, 7 aa, synthetic construct
  REGION 1..7: note = n-mer motif
STNAGQR

SEQ ID NO: 6894 - protein, 7 aa, synthetic construct
  REGION 1..7: note = n-mer motif
KAVSEII

SEQ ID NO: 6895 - protein, 7 aa, synthetic construct
  REGION 1..7: note = n-mer motif
TFTVDGR

SEQ ID NO: 6896 - protein, 7 aa, synthetic construct
  REGION 1..7: note = n-mer motif
STSGYNT

SEQ ID NO: 6897 - protein, 7 aa, synthetic construct
  REGION 1..7: note = n-mer motif
NHSLSEH

SEQ ID NO: 6898 - protein, 7 aa, synthetic construct
  REGION 1..7: note = n-mer motif
SMQDPSL

SEQ ID NO: 6899 - protein, 7 aa, synthetic construct
  REGION 1..7: note = n-mer motif
EQQKTDN

SEQ ID NO: 6900 - protein, 7 aa, synthetic construct
  REGION 1..7: note = n-mer motif
AVVNENM

SEQ ID NO: 6901 - protein, 7 aa, synthetic construct
  REGION 1..7: note = n-mer motif
GPGENYR

SEQ ID NO: 6902 - protein, 7 aa, synthetic construct
  REGION 1..7: note = n-mer motif
YNAGGEQ

SEQ ID NO: 6903 - protein, 7 aa, synthetic construct
  REGION 1..7: note = n-mer motif
VLSSNLY

SEQ ID NO: 6904 - protein, 7 aa, synthetic construct
  REGION 1..7: note = n-mer motif
GLYQNPT

SEQ ID NO: 6905 - protein, 7 aa, synthetic construct
  REGION 1..7: note = n-mer motif
SSGSLIT

SEQ ID NO: 6906 - protein, 7 aa, synthetic construct
  REGION 1..7: note = n-mer motif
YNTDRTN

SEQ ID NO: 6907 - protein, 7 aa, synthetic construct
  REGION 1..7: note = n-mer motif
EKPQHNS

SEQ ID NO: 6908 - protein, 7 aa, synthetic construct
  REGION 1..7: note = n-mer motif
AAYEHAP

SEQ ID NO: 6909 - protein, 7 aa, synthetic construct
  REGION 1..7: note = n-mer motif
GGNYNTT

SEQ ID NO: 6910 - protein, 7 aa, synthetic construct
  REGION 1..7: note = n-mer motif
YLNSTQI

SEQ ID NO: 6911 - protein, 7 aa, synthetic construct
  REGION 1..7: note = n-mer motif
SNSNTAA

SEQ ID NO: 6912 - protein, 7 aa, synthetic construct
  REGION 1..7: note = n-mer motif
SDNRNTA

SEQ ID NO: 6913 - protein, 7 aa, synthetic construct
  REGION 1..7: note = n-mer motif
RSLDSGM

SEQ ID NO: 6914 - protein, 7 aa, synthetic construct
  REGION 1..7: note = n-mer motif
VMDTHGM

SEQ ID NO: 6915 - protein, 7 aa, synthetic construct
  REGION 1..7: note = n-mer motif
HVTAVVD

SEQ ID NO: 6916 - protein, 7 aa, synthetic construct
  REGION 1..7: note = n-mer motif
SITHSNT

SEQ ID NO: 6917 - protein, 7 aa, synthetic construct
  REGION 1..7: note = n-mer motif
GYGSYSN

SEQ ID NO: 6918 - protein, 7 aa, synthetic construct
  REGION 1..7: note = n-mer motif
RWSENNS

SEQ ID NO: 6919 - protein, 7 aa, synthetic construct
  REGION 1..7: note = n-mer motif
MSSHTVQ

SEQ ID NO: 6920 - protein, 7 aa, synthetic construct
  REGION 1..7: note = n-mer motif
YVRAQDQ

SEQ ID NO: 6921 - protein, 7 aa, synthetic construct
  REGION 1..7: note = n-mer motif
FEGDKTY

SEQ ID NO: 6922 - protein, 7 aa, synthetic construct
  REGION 1..7: note = n-mer motif
VSSGHTK

SEQ ID NO: 6923 - protein, 7 aa, synthetic construct
  REGION 1..7: note = n-mer motif
SMNLPTS

SEQ ID NO: 6924 - protein, 7 aa, synthetic construct
  REGION 1..7: note = n-mer motif
LNPQHEL

SEQ ID NO: 6925 - protein, 7 aa, synthetic construct
  REGION 1..7: note = n-mer motif
LPPASAG

SEQ ID NO: 6926 - protein, 7 aa, synthetic construct
  REGION 1..7: note = n-mer motif
GGNSHGV

SEQ ID NO: 6927 - protein, 7 aa, synthetic construct
  REGION 1..7: note = n-mer motif
GGTGLSK

SEQ ID NO: 6928 - protein, 7 aa, synthetic construct
  REGION 1..7: note = n-mer motif
SLNSSST

SEQ ID NO: 6929 - protein, 7 aa, synthetic construct
  REGION 1..7: note = n-mer motif
MPSEPPG

SEQ ID NO: 6930 - protein, 7 aa, synthetic construct
  REGION 1..7: note = n-mer motif
VVHSSIT

SEQ ID NO: 6931 - protein, 7 aa, synthetic construct
  REGION 1..7: note = n-mer motif
LSLAGNR

SEQ ID NO: 6932 - protein, 7 aa, synthetic construct
  REGION 1..7: note = n-mer motif
ADMQHTV

SEQ ID NO: 6933 - protein, 7 aa, synthetic construct
  REGION 1..7: note = n-mer motif
FRDGQGM

SEQ ID NO: 6934 - protein, 7 aa, synthetic construct
  REGION 1..7: note = n-mer motif
TGTAISR

SEQ ID NO: 6935 - protein, 7 aa, synthetic construct
  REGION 1..7: note = n-mer motif
MGKHEGL

SEQ ID NO: 6936 - protein, 7 aa, synthetic construct
  REGION 1..7: note = n-mer motif
PESAAKS

SEQ ID NO: 6937 - protein, 7 aa, synthetic construct
  REGION 1..7: note = n-mer motif
TQAFSLG

SEQ ID NO: 6938 - protein, 7 aa, synthetic construct
  REGION 1..7: note = n-mer motif
TDGIFQP

SEQ ID NO: 6939 - protein, 7 aa, synthetic construct
  REGION 1..7: note = n-mer motif
GSPVIVN

SEQ ID NO: 6940 - protein, 7 aa, synthetic construct
  REGION 1..7: note = n-mer motif
GRDNHHA

SEQ ID NO: 6941 - protein, 7 aa, synthetic construct
  REGION 1..7: note = n-mer motif
PRSITEL

SEQ ID NO: 6942 - protein, 7 aa, synthetic construct
  REGION 1..7: note = n-mer motif
WVNSVGN

SEQ ID NO: 6943 - protein, 7 aa, synthetic construct
  REGION 1..7: note = n-mer motif
VHGTLTY

SEQ ID NO: 6944 - protein, 7 aa, synthetic construct
  REGION 1..7: note = n-mer motif
GVYIDGR

SEQ ID NO: 6945 - protein, 7 aa, synthetic construct
  REGION 1..7: note = n-mer motif
MSNDLPG

SEQ ID NO: 6946 - protein, 7 aa, synthetic construct
  REGION 1..7: note = n-mer motif
NRSDSFA

SEQ ID NO: 6947 - protein, 7 aa, synthetic construct
  REGION 1..7: note = n-mer motif
GQTNAVH

SEQ ID NO: 6948 - protein, 7 aa, synthetic construct
  REGION 1..7: note = n-mer motif
YVDKSMT

SEQ ID NO: 6949 - protein, 7 aa, synthetic construct
  REGION 1..7: note = n-mer motif
SVMVGTN

SEQ ID NO: 6950 - protein, 7 aa, synthetic construct
  REGION 1..7: note = n-mer motif
IGLQNST

SEQ ID NO: 6951 - protein, 7 aa, synthetic construct
  REGION 1..7: note = n-mer motif
NDRPLAS

SEQ ID NO: 6952 - protein, 7 aa, synthetic construct
  REGION 1..7: note = n-mer motif
LMGSPGA

SEQ ID NO: 6953 - protein, 7 aa, synthetic construct
  REGION 1..7: note = n-mer motif
IDRSASL

SEQ ID NO: 6954 - protein, 7 aa, synthetic construct
  REGION 1..7: note = n-mer motif
IQAKNSE

SEQ ID NO: 6955 - protein, 7 aa, synthetic construct
  REGION 1..7: note = n-mer motif
HQSFDAG

SEQ ID NO: 6956 - protein, 7 aa, synthetic construct
  REGION 1..7: note = n-mer motif
AVNETRL

SEQ ID NO: 6957 - protein, 7 aa, synthetic construct
  REGION 1..7: note = n-mer motif
IASTWNM

SEQ ID NO: 6958 - protein, 7 aa, synthetic construct
  REGION 1..7: note = n-mer motif
KVDMTSK

SEQ ID NO: 6959 - protein, 7 aa, synthetic construct
  REGION 1..7: note = n-mer motif
SHSITGL

SEQ ID NO: 6960 - protein, 7 aa, synthetic construct
  REGION 1..7: note = n-mer motif
TITSPSV

SEQ ID NO: 6961 - protein, 7 aa, synthetic construct
  REGION 1..7: note = n-mer motif
EHISSYG

SEQ ID NO: 6962 - protein, 7 aa, synthetic construct
  REGION 1..7: note = n-mer motif
FSTNSVI

SEQ ID NO: 6963 - protein, 7 aa, synthetic construct
  REGION 1..7: note = n-mer motif
SMEGQQH

SEQ ID NO: 6964 - protein, 7 aa, synthetic construct
  REGION 1..7: note = n-mer motif
VDKSEAV

SEQ ID NO: 6965 - protein, 7 aa, synthetic construct
  REGION 1..7: note = n-mer motif
QANLSII

SEQ ID NO: 6966 - protein, 7 aa, synthetic construct
  REGION 1..7: note = n-mer motif
VKASAGV

SEQ ID NO: 6967 - protein, 7 aa, synthetic construct
  REGION 1..7: note = n-mer motif
FGTSYTT

SEQ ID NO: 6968 - protein, 7 aa, synthetic construct
  REGION 1..7: note = n-mer motif
GLTGYPM

SEQ ID NO: 6969 - protein, 7 aa, synthetic construct
  REGION 1..7: note = n-mer motif
AMGALVH

SEQ ID NO: 6970 - protein, 7 aa, synthetic construct
  REGION 1..7: note = n-mer motif
VYATALA

SEQ ID NO: 6971 - protein, 7 aa, synthetic construct
  REGION 1..7: note = n-mer motif
TLTDVHR

SEQ ID NO: 6972 - protein, 7 aa, synthetic construct
  REGION 1..7: note = n-mer motif
PSSAGST

SEQ ID NO: 6973 - protein, 6 aa, synthetic construct
  REGION 1..6: note = n-mer motif
KKRKHL

SEQ ID NO: 6974 - protein, 7 aa, synthetic construct
  REGION 1..7: note = n-mer motif
AYQLTPA

SEQ ID NO: 6975 - protein, 7 aa, synthetic construct
  REGION 1..7: note = n-mer motif
LAPDNIG

SEQ ID NO: 6976 - protein, 7 aa, synthetic construct
  REGION 1..7: note = n-mer motif
TIVSAYA

SEQ ID NO: 6977 - protein, 7 aa, synthetic construct
  REGION 1..7: note = n-mer motif
GNNLSLS

SEQ ID NO: 6978 - protein, 7 aa, synthetic construct
  REGION 1..7: note = n-mer motif
STNTEPR

SEQ ID NO: 6979 - protein, 7 aa, synthetic construct
  REGION 1..7: note = n-mer motif
SFQTDRA

SEQ ID NO: 6980 - protein, 7 aa, synthetic construct
  REGION 1..7: note = n-mer motif
FLEGVAQ

SEQ ID NO: 6981 - protein, 7 aa, synthetic construct
  REGION 1..7: note = n-mer motif
QDVGRTN

SEQ ID NO: 6982 - protein, 7 aa, synthetic construct
  REGION 1..7: note = n-mer motif
THGDHIQ

SEQ ID NO: 6983 - protein, 7 aa, synthetic construct
  REGION 1..7: note = n-mer motif
VSEGQRI

SEQ ID NO: 6984 - protein, 7 aa, synthetic construct
  REGION 1..7: note = n-mer motif
NMGPMGR

SEQ ID NO: 6985 - protein, 7 aa, synthetic construct
  REGION 1..7: note = n-mer motif
LPSTETL

SEQ ID NO: 6986 - protein, 7 aa, synthetic construct
  REGION 1..7: note = n-mer motif
GGMSAHS

SEQ ID NO: 6987 - protein, 7 aa, synthetic construct
  REGION 1..7: note = n-mer motif
GMIGHNA

SEQ ID NO: 6988 - protein, 7 aa, synthetic construct
  REGION 1..7: note = n-mer motif
IDERSSI

SEQ ID NO: 6989 - protein, 7 aa, synthetic construct
  REGION 1..7: note = n-mer motif
HVNPTPA

SEQ ID NO: 6990 - protein, 7 aa, synthetic construct
  REGION 1..7: note = n-mer motif
WSRTGNT

SEQ ID NO: 6991 - protein, 7 aa, synthetic construct
  REGION 1..7: note = n-mer motif
IKDSYLT

SEQ ID NO: 6992 - protein, 7 aa, synthetic construct
  REGION 1..7: note = n-mer motif
LNQNSVS

SEQ ID NO: 6993 - protein, 7 aa, synthetic construct
  REGION 1..7: note = n-mer motif
SGPIPAV

SEQ ID NO: 6994 - protein, 7 aa, synthetic construct
  REGION 1..7: note = n-mer motif
MQGLNNM

SEQ ID NO: 6995 - protein, 7 aa, synthetic construct
  REGION 1..7: note = n-mer motif
SNSGGNH

SEQ ID NO: 6996 - protein, 7 aa, synthetic construct
  REGION 1..7: note = n-mer motif
TSTMTAR

SEQ ID NO: 6997 - protein, 7 aa, synthetic construct
  REGION 1..7: note = n-mer motif
ENSDLSY

SEQ ID NO: 6998 - protein, 7 aa, synthetic construct
  REGION 1..7: note = n-mer motif
HPGNSSV

SEQ ID NO: 6999 - protein, 7 aa, synthetic construct
  REGION 1..7: note = n-mer motif
LTPQGTS

SEQ ID NO: 7000 - protein, 7 aa, synthetic construct
  REGION 1..7: note = n-mer motif
TDTRKND

SEQ ID NO: 7001 - protein, 7 aa, synthetic construct
  REGION 1..7: note = n-mer motif
GETLRSQ

SEQ ID NO: 7002 - protein, 7 aa, synthetic construct
  REGION 1..7: note = n-mer motif
SGVSEGN

SEQ ID NO: 7003 - protein, 7 aa, synthetic construct
  REGION 1..7: note = n-mer motif
TQYGTLP

SEQ ID NO: 7004 - protein, 7 aa, synthetic construct
  REGION 1..7: note = n-mer motif
GTVNSSA

SEQ ID NO: 7005 - protein, 7 aa, synthetic construct
  REGION 1..7: note = n-mer motif
GKATLVL

SEQ ID NO: 7006 - protein, 7 aa, synthetic construct
  REGION 1..7: note = n-mer motif
GIYPAST

SEQ ID NO: 7007 - protein, 7 aa, synthetic construct
  REGION 1..7: note = n-mer motif
GVMSNAT

SEQ ID NO: 7008 - protein, 7 aa, synthetic construct
  REGION 1..7: note = n-mer motif
THVIGAV

SEQ ID NO: 7009 - protein, 7 aa, synthetic construct
  REGION 1..7: note = n-mer motif
TRSDIGV

SEQ ID NO: 7010 - protein, 7 aa, synthetic construct
  REGION 1..7: note = n-mer motif
TLTLSTL

SEQ ID NO: 7011 - protein, 7 aa, synthetic construct
  REGION 1..7: note = n-mer motif
YNESSNA

SEQ ID NO: 7012 - protein, 7 aa, synthetic construct
  REGION 1..7: note = n-mer motif
STQAQTG

SEQ ID NO: 7013 - protein, 7 aa, synthetic construct
  REGION 1..7: note = n-mer motif
RDMINSS

SEQ ID NO: 7014 - protein, 7 aa, synthetic construct
  REGION 1..7: note = n-mer motif
TKGNNLV

SEQ ID NO: 7015 - protein, 7 aa, synthetic construct
  REGION 1..7: note = n-mer motif
GSTVSAQ

SEQ ID NO: 7016 - protein, 7 aa, synthetic construct
  REGION 1..7: note = n-mer motif
RGDTMNY

SEQ ID NO: 7017 - protein, 7 aa, synthetic construct
  REGION 1..7: note = n-mer motif
HADVNAG

SEQ ID NO: 7018 - protein, 7 aa, synthetic construct
  REGION 1..7: note = n-mer motif
SVVNTNI

SEQ ID NO: 7019 - protein, 7 aa, synthetic construct
  REGION 1..7: note = n-mer motif
SNVHVVN

SEQ ID NO: 7020 - protein, 7 aa, synthetic construct
  REGION 1..7: note = n-mer motif
SVDKPPG

SEQ ID NO: 7021 - protein, 7 aa, synthetic construct
  REGION 1..7: note = n-mer motif
DRTYSNT

SEQ ID NO: 7022 - protein, 7 aa, synthetic construct
  REGION 1..7: note = n-mer motif
YSGELNK

SEQ ID NO: 7023 - protein, 7 aa, synthetic construct
  REGION 1..7: note = n-mer motif
YDKTLSV

SEQ ID NO: 7024 - protein, 7 aa, synthetic construct
  REGION 1..7: note = n-mer motif
HTATLSS

SEQ ID NO: 7025 - protein, 7 aa, synthetic construct
  REGION 1..7: note = n-mer motif
ALERAQY

SEQ ID NO: 7026 - protein, 7 aa, synthetic construct
  REGION 1..7: note = n-mer motif
GTSDNYR

SEQ ID NO: 7027 - protein, 7 aa, synthetic construct
  REGION 1..7: note = n-mer motif
HVNSRDL

SEQ ID NO: 7028 - protein, 7 aa, synthetic construct
  REGION 1..7: note = n-mer motif
SSDVTRQ

SEQ ID NO: 7029 - protein, 7 aa, synthetic construct
  REGION 1..7: note = n-mer motif
AHHMTTE

SEQ ID NO: 7030 - protein, 7 aa, synthetic construct
  REGION 1..7: note = n-mer motif
EVSRDGL

SEQ ID NO: 7031 - protein, 7 aa, synthetic construct
  REGION 1..7: note = n-mer motif
VGRDAEA

SEQ ID NO: 7032 - protein, 7 aa, synthetic construct
  REGION 1..7: note = n-mer motif
AHQKDLR

SEQ ID NO: 7033 - protein, 7 aa, synthetic construct
  REGION 1..7: note = n-mer motif
SVLSSST

SEQ ID NO: 7034 - protein, 7 aa, synthetic construct
  REGION 1..7: note = n-mer motif
LGTLLSQ

SEQ ID NO: 7035 - protein, 7 aa, synthetic construct
  REGION 1..7: note = n-mer motif
SQKPIDD

SEQ ID NO: 7036 - protein, 7 aa, synthetic construct
  REGION 1..7: note = n-mer motif
DNVHGQV

SEQ ID NO: 7037 - protein, 7 aa, synthetic construct
  REGION 1..7: note = n-mer motif
GSHNGPT

SEQ ID NO: 7038 - protein, 7 aa, synthetic construct
  REGION 1..7: note = n-mer motif
ISGSSSL

SEQ ID NO: 7039 - protein, 7 aa, synthetic construct
  REGION 1..7: note = n-mer motif
GFHINGE

SEQ ID NO: 7040 - protein, 7 aa, synthetic construct
  REGION 1..7: note = n-mer motif
MSDGHSK

SEQ ID NO: 7041 - protein, 7 aa, synthetic construct
  REGION 1..7: note = n-mer motif
TVGGNHH

SEQ ID NO: 7042 - protein, 7 aa, synthetic construct
  REGION 1..7: note = n-mer motif
NATPPNH

SEQ ID NO: 7043 - protein, 7 aa, synthetic construct
  REGION 1..7: note = n-mer motif
TGMNSNK

SEQ ID NO: 7044 - protein, 7 aa, synthetic construct
  REGION 1..7: note = n-mer motif
IEAYSRD

SEQ ID NO: 7045 - protein, 7 aa, synthetic construct
  REGION 1..7: note = n-mer motif
RDRQDSV

SEQ ID NO: 7046 - protein, 7 aa, synthetic construct
  REGION 1..7: note = n-mer motif
HTVQIRE

SEQ ID NO: 7047 - protein, 7 aa, synthetic construct
  REGION 1..7: note = n-mer motif
TLTQTGM

SEQ ID NO: 7048 - protein, 7 aa, synthetic construct
  REGION 1..7: note = n-mer motif
INNFNTL

SEQ ID NO: 7049 - protein, 7 aa, synthetic construct
  REGION 1..7: note = n-mer motif
VAAGPEA

SEQ ID NO: 7050 - protein, 7 aa, synthetic construct
  REGION 1..7: note = n-mer motif
DGKNSYA

SEQ ID NO: 7051 - protein, 7 aa, synthetic construct
  REGION 1..7: note = n-mer motif
SRQENFS

SEQ ID NO: 7052 - protein, 7 aa, synthetic construct
  REGION 1..7: note = n-mer motif
SNSSVAV

SEQ ID NO: 7053 - protein, 7 aa, synthetic construct
  REGION 1..7: note = n-mer motif
DHSKQSS

SEQ ID NO: 7054 - protein, 7 aa, synthetic construct
  REGION 1..7: note = n-mer motif
LSGAGSQ

SEQ ID NO: 7055 - protein, 7 aa, synthetic construct
  REGION 1..7: note = n-mer motif
GWSNNEL

SEQ ID NO: 7056 - protein, 7 aa, synthetic construct
  REGION 1..7: note = n-mer motif
LIRGSME

SEQ ID NO: 7057 - protein, 7 aa, synthetic construct
  REGION 1..7: note = n-mer motif
NTYTAGK

SEQ ID NO: 7058 - protein, 7 aa, synthetic construct
  REGION 1..7: note = n-mer motif
TRGDMEF

SEQ ID NO: 7059 - protein, 7 aa, synthetic construct
  REGION 1..7: note = n-mer motif
LMSGKEN

SEQ ID NO: 7060 - protein, 7 aa, synthetic construct
  REGION 1..7: note = n-mer motif
KDTNQQI

SEQ ID NO: 7061 - protein, 7 aa, synthetic construct
  REGION 1..7: note = n-mer motif
HNVGLGH

SEQ ID NO: 7062 - protein, 7 aa, synthetic construct
  REGION 1..7: note = n-mer motif
PDQPGPS

SEQ ID NO: 7063 - protein, 7 aa, synthetic construct
  REGION 1..7: note = n-mer motif
MQREAAN

SEQ ID NO: 7064 - protein, 7 aa, synthetic construct
  REGION 1..7: note = n-mer motif
GQRTTND

SEQ ID NO: 7065 - protein, 7 aa, synthetic construct
  REGION 1..7: note = n-mer motif
KHTENGT

SEQ ID NO: 7066 - protein, 7 aa, synthetic construct
  REGION 1..7: note = n-mer motif
LDVTRMR

SEQ ID NO: 7067 - protein, 7 aa, synthetic construct
  REGION 1..7: note = n-mer motif
TLDRNQT

SEQ ID NO: 7068 - protein, 7 aa, synthetic construct
  REGION 1..7: note = n-mer motif
INAGNYR

SEQ ID NO: 7069 - protein, 7 aa, synthetic construct
  REGION 1..7: note = n-mer motif
AVDQSRL

SEQ ID NO: 7070 - protein, 7 aa, synthetic construct
  REGION 1..7: note = n-mer motif
ALGHQGN

SEQ ID NO: 7071 - protein, 7 aa, synthetic construct
  REGION 1..7: note = n-mer motif
LPRHDQY

SEQ ID NO: 7072 - protein, 7 aa, synthetic construct
  REGION 1..7: note = n-mer motif
ISGSSSL

SEQ ID NO: 7073 - protein, 7 aa, synthetic construct
  REGION 1..7: note = n-mer motif
WNTNMAI

SEQ ID NO: 7074 - protein, 7 aa, synthetic construct
  REGION 1..7: note = n-mer motif
MSDRTSD

SEQ ID NO: 7075 - protein, 7 aa, synthetic construct
  REGION 1..7: note = n-mer motif
TRESMSI

SEQ ID NO: 7076 - protein, 7 aa, synthetic construct
  REGION 1..7: note = n-mer motif
QRGELPA

SEQ ID NO: 7077 - protein, 7 aa, synthetic construct
  REGION 1..7: note = n-mer motif
SSDPKGQ

SEQ ID NO: 7078 - protein, 7 aa, synthetic construct
  REGION 1..7: note = n-mer motif
PSDRTTY

SEQ ID NO: 7079 - protein, 7 aa, synthetic construct
  REGION 1..7: note = n-mer motif
SSSDSPR

SEQ ID NO: 7080 - protein, 7 aa, synthetic construct
  REGION 1..7: note = n-mer motif
VLHSVSA

SEQ ID NO: 7081 - protein, 7 aa, synthetic construct
  REGION 1..7: note = n-mer motif
SMQSYTM

SEQ ID NO: 7082 - protein, 7 aa, synthetic construct
  REGION 1..7: note = n-mer motif
SLQLTAG

SEQ ID NO: 7083 - protein, 7 aa, synthetic construct
  REGION 1..7: note = n-mer motif
NNVNPYS

SEQ ID NO: 7084 - protein, 7 aa, synthetic construct
  REGION 1..7: note = n-mer motif
LANGMTA

SEQ ID NO: 7085 - protein, 7 aa, synthetic construct
  REGION 1..7: note = n-mer motif
GITGSTG

SEQ ID NO: 7086 - protein, 7 aa, synthetic construct
  REGION 1..7: note = n-mer motif
MLVQNTP

SEQ ID NO: 7087 - protein, 7 aa, synthetic construct
  REGION 1..7: note = n-mer motif
DANAGTR

SEQ ID NO: 7088 - protein, 7 aa, synthetic construct
  REGION 1..7: note = n-mer motif
ETGAMTS

SEQ ID NO: 7089 - protein, 7 aa, synthetic construct
  REGION 1..7: note = n-mer motif
IQTTTKC

SEQ ID NO: 7090 - protein, 7 aa, synthetic construct
  REGION 1..7: note = n-mer motif
AQQSLHG

SEQ ID NO: 7091 - protein, 7 aa, synthetic construct
  REGION 1..7: note = n-mer motif
IDSTWNT

SEQ ID NO: 7092 - protein, 7 aa, synthetic construct
  REGION 1..7: note = n-mer motif
TESQTMR

SEQ ID NO: 7093 - protein, 7 aa, synthetic construct
  REGION 1..7: note = n-mer motif
LIQTQGT

SEQ ID NO: 7094 - protein, 7 aa, synthetic construct
  REGION 1..7: note = n-mer motif
IVNITQS

SEQ ID NO: 7095 - protein, 7 aa, synthetic construct
  REGION 1..7: note = n-mer motif
VAVSNTP

SEQ ID NO: 7096 - protein, 7 aa, synthetic construct
  REGION 1..7: note = n-mer motif
GHRDSGG

SEQ ID NO: 7097 - protein, 7 aa, synthetic construct
  REGION 1..7: note = n-mer motif
RNENLNN

SEQ ID NO: 7098 - protein, 7 aa, synthetic construct
  REGION 1..7: note = n-mer motif
VMQRSAQ

SEQ ID NO: 7099 - protein, 7 aa, synthetic construct
  REGION 1..7: note = n-mer motif
VSGPVSV

SEQ ID NO: 7100 - protein, 7 aa, synthetic construct
  REGION 1..7: note = n-mer motif
GDIQSHS

SEQ ID NO: 7101 - protein, 7 aa, synthetic construct
  REGION 1..7: note = n-mer motif
VEKPLET

SEQ ID NO: 7102 - protein, 7 aa, synthetic construct
  REGION 1..7: note = n-mer motif
GVQMTAG

SEQ ID NO: 7103 - protein, 7 aa, synthetic construct
  REGION 1..7: note = n-mer motif
TTKTTSM

SEQ ID NO: 7104 - protein, 7 aa, synthetic construct
  REGION 1..7: note = n-mer motif
PGNPSSN

SEQ ID NO: 7105 - protein, 7 aa, synthetic construct
  REGION 1..7: note = n-mer motif
ASRPAAQ

SEQ ID NO: 7106 - protein, 7 aa, synthetic construct
  REGION 1..7: note = n-mer motif
VHDQGAG

SEQ ID NO: 7107 - protein, 7 aa, synthetic construct
  REGION 1..7: note = n-mer motif
SGSEYRT

SEQ ID NO: 7108 - protein, 7 aa, synthetic construct
  REGION 1..7: note = n-mer motif
YVDDNSR

SEQ ID NO: 7109 - protein, 7 aa, synthetic construct
  REGION 1..7: note = n-mer motif
MAGDQEL

SEQ ID NO: 7110 - protein, 7 aa, synthetic construct
  REGION 1..7: note = n-mer motif
PLHNIPP

SEQ ID NO: 7111 - protein, 7 aa, synthetic construct
  REGION 1..7: note = n-mer motif
SGIGTYS

SEQ ID NO: 7112 - protein, 7 aa, synthetic construct
  REGION 1..7: note = n-mer motif
SNADILA

SEQ ID NO: 7113 - protein, 7 aa, synthetic construct
  REGION 1..7: note = n-mer motif
SHNQVNV

SEQ ID NO: 7114 - protein, 7 aa, synthetic construct
  REGION 1..7: note = n-mer motif
QHSPKPV

SEQ ID NO: 7115 - protein, 7 aa, synthetic construct
  REGION 1..7: note = n-mer motif
SANNIAP

SEQ ID NO: 7116 - protein, 7 aa, synthetic construct
  REGION 1..7: note = n-mer motif
EETRTRM

SEQ ID NO: 7117 - protein, 7 aa, synthetic construct
  REGION 1..7: note = n-mer motif
LSNSITP

SEQ ID NO: 7118 - protein, 7 aa, synthetic construct
  REGION 1..7: note = n-mer motif
SALNSVD

SEQ ID NO: 7119 - protein, 7 aa, synthetic construct
  REGION 1..7: note = n-mer motif
TNLAVTL

SEQ ID NO: 7120 - protein, 7 aa, synthetic construct
  REGION 1..7: note = n-mer motif
QSTLNRP

SEQ ID NO: 7121 - protein, 7 aa, synthetic construct
  REGION 1..7: note = n-mer motif
IEHMLRP

SEQ ID NO: 7122 - protein, 7 aa, synthetic construct
  REGION 1..7: note = n-mer motif
PTPNEHM

SEQ ID NO: 7123 - protein, 7 aa, synthetic construct
  REGION 1..7: note = n-mer motif
INEIGRM

SEQ ID NO: 7124 - protein, 7 aa, synthetic construct
  REGION 1..7: note = n-mer motif
NNDNVYV

SEQ ID NO: 7125 - protein, 7 aa, synthetic construct
  REGION 1..7: note = n-mer motif
IVHTPQV

SEQ ID NO: 7126 - protein, 7 aa, synthetic construct
  REGION 1..7: note = n-mer motif
HKSESHN

SEQ ID NO: 7127 - protein, 7 aa, synthetic construct
  REGION 1..7: note = n-mer motif
SSSDSPR

SEQ ID NO: 7128 - protein, 7 aa, synthetic construct
  REGION 1..7: note = n-mer motif
YSTEARV

SEQ ID NO: 7129 - protein, 7 aa, synthetic construct
  REGION 1..7: note = n-mer motif
TSGDRYT

SEQ ID NO: 7130 - protein, 7 aa, synthetic construct
  REGION 1..7: note = n-mer motif
EKNLTNA

SEQ ID NO: 7131 - protein, 7 aa, synthetic construct
  REGION 1..7: note = n-mer motif
TRDQRST

SEQ ID NO: 7132 - protein, 7 aa, synthetic construct
  REGION 1..7: note = n-mer motif
ATDKMTP

SEQ ID NO: 7133 - protein, 7 aa, synthetic construct
  REGION 1..7: note = n-mer motif
NSYTAGK

SEQ ID NO: 7134 - protein, 7 aa, synthetic construct
  REGION 1..7: note = n-mer motif
TLDTKDL

SEQ ID NO: 7135 - protein, 7 aa, synthetic construct
  REGION 1..7: note = n-mer motif
ASNGQVN

SEQ ID NO: 7136 - protein, 7 aa, synthetic construct
  REGION 1..7: note = n-mer motif
TSISSQS

SEQ ID NO: 7137 - protein, 7 aa, synthetic construct
  REGION 1..7: note = n-mer motif
DNSPANH

SEQ ID NO: 7138 - protein, 7 aa, synthetic construct
  REGION 1..7: note = n-mer motif
NSREMGV

SEQ ID NO: 7139 - protein, 7 aa, synthetic construct
  REGION 1..7: note = n-mer motif
TSASENW

SEQ ID NO: 7140 - protein, 7 aa, synthetic construct
  REGION 1..7: note = n-mer motif
TVGSSYA

SEQ ID NO: 7141 - protein, 7 aa, synthetic construct
  REGION 1..7: note = n-mer motif
QQSQNSI

SEQ ID NO: 7142 - protein, 7 aa, synthetic construct
  REGION 1..7: note = n-mer motif
LRDGIAS

SEQ ID NO: 7143 - protein, 7 aa, synthetic construct
  REGION 1..7: note = n-mer motif
VQKTTAW

SEQ ID NO: 7144 - protein, 7 aa, synthetic construct
  REGION 1..7: note = n-mer motif
MSTVLRE

SEQ ID NO: 7145 - protein, 7 aa, synthetic construct
  REGION 1..7: note = n-mer motif
SMDARLT

SEQ ID NO: 7146 - protein, 7 aa, synthetic construct
  REGION 1..7: note = n-mer motif
GARTILD

SEQ ID NO: 7147 - protein, 7 aa, synthetic construct
  REGION 1..7: note = n-mer motif
HESHYVS

SEQ ID NO: 7148 - protein, 7 aa, synthetic construct
  REGION 1..7: note = n-mer motif
LEGQNKT

SEQ ID NO: 7149 - protein, 7 aa, synthetic construct
  REGION 1..7: note = n-mer motif
RDLRPVT

SEQ ID NO: 7150 - protein, 7 aa, synthetic construct
  REGION 1..7: note = n-mer motif
QILNYSV

SEQ ID NO: 7151 - protein, 7 aa, synthetic construct
  REGION 1..7: note = n-mer motif
ISVGVSV

SEQ ID NO: 7152 - protein, 7 aa, synthetic construct
  REGION 1..7: note = n-mer motif
KAGEYRD

SEQ ID NO: 7153 - protein, 7 aa, synthetic construct
  REGION 1..7: note = n-mer motif
LTTNGML

SEQ ID NO: 7154 - protein, 7 aa, synthetic construct
  REGION 1..7: note = n-mer motif
TSNYMHE

SEQ ID NO: 7155 - protein, 7 aa, synthetic construct
  REGION 1..7: note = n-mer motif
THNSTGL

SEQ ID NO: 7156 - protein, 7 aa, synthetic construct
  REGION 1..7: note = n-mer motif
NNVVRDD

SEQ ID NO: 7157 - protein, 7 aa, synthetic construct
  REGION 1..7: note = n-mer motif
SGTYASR

SEQ ID NO: 7158 - protein, 7 aa, synthetic construct
  REGION 1..7: note = n-mer motif
LSHAMDR

SEQ ID NO: 7159 - protein, 7 aa, synthetic construct
  REGION 1..7: note = n-mer motif
NWNSEGT

SEQ ID NO: 7160 - protein, 7 aa, synthetic construct
  REGION 1..7: note = n-mer motif
SLRPTLP

SEQ ID NO: 7161 - protein, 7 aa, synthetic construct
  REGION 1..7: note = n-mer motif
YQTGDKD

SEQ ID NO: 7162 - protein, 7 aa, synthetic construct
  REGION 1..7: note = n-mer motif
RSDKGTL

SEQ ID NO: 7163 - protein, 7 aa, synthetic construct
  REGION 1..7: note = n-mer motif
STIGNST

SEQ ID NO: 7164 - protein, 7 aa, synthetic construct
  REGION 1..7: note = n-mer motif
ENNMQHG

SEQ ID NO: 7165 - protein, 7 aa, synthetic construct
  REGION 1..7: note = n-mer motif
KYTESNA

SEQ ID NO: 7166 - protein, 7 aa, synthetic construct
  REGION 1..7: note = n-mer motif
PTNNLSM

SEQ ID NO: 7167 - protein, 7 aa, synthetic construct
  REGION 1..7: note = n-mer motif
CKNNSEC

SEQ ID NO: 7168 - protein, 7 aa, synthetic construct
  REGION 1..7: note = n-mer motif
TVNADGS

SEQ ID NO: 7169 - protein, 7 aa, synthetic construct
  REGION 1..7: note = n-mer motif
FSGQALA

SEQ ID NO: 7170 - protein, 7 aa, synthetic construct
  REGION 1..7: note = n-mer motif
NHIRNPM

SEQ ID NO: 7171 - protein, 7 aa, synthetic construct
  REGION 1..7: note = n-mer motif
MVNSENT

SEQ ID NO: 7172 - protein, 7 aa, synthetic construct
  REGION 1..7: note = n-mer motif
TDGPRLA

SEQ ID NO: 7173 - protein, 7 aa, synthetic construct
  REGION 1..7: note = n-mer motif
FNGYVMA

SEQ ID NO: 7174 - protein, 7 aa, synthetic construct
  REGION 1..7: note = n-mer motif
NANGPVS

SEQ ID NO: 7175 - protein, 7 aa, synthetic construct
  REGION 1..7: note = n-mer motif
STSQENR

SEQ ID NO: 7176 - protein, 7 aa, synthetic construct
  REGION 1..7: note = n-mer motif
QGTLLSP

SEQ ID NO: 7177 - protein, 7 aa, synthetic construct
  REGION 1..7: note = n-mer motif
LITATTN

SEQ ID NO: 7178 - protein, 7 aa, synthetic construct
  REGION 1..7: note = n-mer motif
SGVSKER

SEQ ID NO: 7179 - protein, 7 aa, synthetic construct
  REGION 1..7: note = n-mer motif
STSIGVV

SEQ ID NO: 7180 - protein, 7 aa, synthetic construct
  REGION 1..7: note = n-mer motif
SHVTVTD

SEQ ID NO: 7181 - protein, 7 aa, synthetic construct
  REGION 1..7: note = n-mer motif
SNNLNQE

SEQ ID NO: 7182 - protein, 7 aa, synthetic construct
  REGION 1..7: note = n-mer motif
ANHDNIV

SEQ ID NO: 7183 - protein, 7 aa, synthetic construct
  REGION 1..7: note = n-mer motif
DTSSGNR

SEQ ID NO: 7184 - protein, 7 aa, synthetic construct
  REGION 1..7: note = n-mer motif
VVPMPTT

SEQ ID NO: 7185 - protein, 7 aa, synthetic construct
  REGION 1..7: note = n-mer motif
LTNNFKD

SEQ ID NO: 7186 - protein, 7 aa, synthetic construct
  REGION 1..7: note = n-mer motif
SSPTKGT

SEQ ID NO: 7187 - protein, 7 aa, synthetic construct
  REGION 1..7: note = n-mer motif
DIPSDNT

SEQ ID NO: 7188 - protein, 7 aa, synthetic construct
  REGION 1..7: note = n-mer motif
YTGFELR

SEQ ID NO: 7189 - protein, 7 aa, synthetic construct
  REGION 1..7: note = n-mer motif
NSGNNPI

SEQ ID NO: 7190 - protein, 7 aa, synthetic construct
  REGION 1..7: note = n-mer motif
TTRNEHS

SEQ ID NO: 7191 - protein, 7 aa, synthetic construct
  REGION 1..7: note = n-mer motif
NVGNTLG

SEQ ID NO: 7192 - protein, 7 aa, synthetic construct
  REGION 1..7: note = n-mer motif
YHTHQVA

SEQ ID NO: 7193 - protein, 7 aa, synthetic construct
  REGION 1..7: note = n-mer motif
GSASNSG

SEQ ID NO: 7194 - protein, 7 aa, synthetic construct
  REGION 1..7: note = n-mer motif
GKNQPTP

SEQ ID NO: 7195 - protein, 7 aa, synthetic construct
  REGION 1..7: note = n-mer motif
FTATLGT

SEQ ID NO: 7196 - protein, 7 aa, synthetic construct
  REGION 1..7: note = n-mer motif
MNQMGGL

SEQ ID NO: 7197 - protein, 7 aa, synthetic construct
  REGION 1..7: note = n-mer motif
NVSLTQT

SEQ ID NO: 7198 - protein, 7 aa, synthetic construct
  REGION 1..7: note = n-mer motif
SSSNTNA

SEQ ID NO: 7199 - protein, 7 aa, synthetic construct
  REGION 1..7: note = n-mer motif
TNSNQSS

SEQ ID NO: 7200 - protein, 7 aa, synthetic construct
  REGION 1..7: note = n-mer motif
ISHDLKY

SEQ ID NO: 7201 - protein, 7 aa, synthetic construct
  REGION 1..7: note = n-mer motif
DSTYVLA

SEQ ID NO: 7202 - protein, 7 aa, synthetic construct
  REGION 1..7: note = n-mer motif
MNTGSSS

SEQ ID NO: 7203 - protein, 7 aa, synthetic construct
  REGION 1..7: note = n-mer motif
AGNYQSS

SEQ ID NO: 7204 - protein, 7 aa, synthetic construct
  REGION 1..7: note = n-mer motif
TIYNMGP

SEQ ID NO: 7205 - protein, 7 aa, synthetic construct
  REGION 1..7: note = n-mer motif
VSTTTDR

SEQ ID NO: 7206 - protein, 7 aa, synthetic construct
  REGION 1..7: note = n-mer motif
GVTVREL

SEQ ID NO: 7207 - protein, 7 aa, synthetic construct
  REGION 1..7: note = n-mer motif
DITNQSY

SEQ ID NO: 7208 - protein, 7 aa, synthetic construct
  REGION 1..7: note = n-mer motif
NQSLTMD

SEQ ID NO: 7209 - protein, 7 aa, synthetic construct
  REGION 1..7: note = n-mer motif
TNYNIGP

SEQ ID NO: 7210 - protein, 7 aa, synthetic construct
  REGION 1..7: note = n-mer motif
RGTEGTP

SEQ ID NO: 7211 - protein, 7 aa, synthetic construct
  REGION 1..7: note = n-mer motif
PITRESG

SEQ ID NO: 7212 - protein, 7 aa, synthetic construct
  REGION 1..7: note = n-mer motif
TGQAGGS

SEQ ID NO: 7213 - protein, 7 aa, synthetic construct
  REGION 1..7: note = n-mer motif
MTKHDAT

SEQ ID NO: 7214 - protein, 7 aa, synthetic construct
  REGION 1..7: note = n-mer motif
PIPHGSS

SEQ ID NO: 7215 - protein, 7 aa, synthetic construct
  REGION 1..7: note = n-mer motif
TTGGTGM

SEQ ID NO: 7216 - protein, 7 aa, synthetic construct
  REGION 1..7: note = n-mer motif
LTESVRN

SEQ ID NO: 7217 - protein, 7 aa, synthetic construct
  REGION 1..7: note = n-mer motif
SSNLTLS

SEQ ID NO: 7218 - protein, 7 aa, synthetic construct
  REGION 1..7: note = n-mer motif
LNNSATV

SEQ ID NO: 7219 - protein, 7 aa, synthetic construct
  REGION 1..7: note = n-mer motif
AYGSSGR

SEQ ID NO: 7220 - protein, 7 aa, synthetic construct
  REGION 1..7: note = n-mer motif
VSYDNGS

SEQ ID NO: 7221 - protein, 7 aa, synthetic construct
  REGION 1..7: note = n-mer motif
PSQSRSL

SEQ ID NO: 7222 - protein, 7 aa, synthetic construct
  REGION 1..7: note = n-mer motif
VLVNVHN

SEQ ID NO: 7223 - protein, 7 aa, synthetic construct
  REGION 1..7: note = n-mer motif
LMTGTAS

SEQ ID NO: 7224 - protein, 7 aa, synthetic construct
  REGION 1..7: note = n-mer motif
AAGNPTR

SEQ ID NO: 7225 - protein, 7 aa, synthetic construct
  REGION 1..7: note = n-mer motif
SAQSFVV

SEQ ID NO: 7226 - protein, 7 aa, synthetic construct
  REGION 1..7: note = n-mer motif
QDQTSNR

SEQ ID NO: 7227 - protein, 7 aa, synthetic construct
  REGION 1..7: note = n-mer motif
QSIGHPV

SEQ ID NO: 7228 - protein, 7 aa, synthetic construct
  REGION 1..7: note = n-mer motif
AGVRESF

SEQ ID NO: 7229 - protein, 7 aa, synthetic construct
  REGION 1..7: note = n-mer motif
NTNYAMH

SEQ ID NO: 7230 - protein, 7 aa, synthetic construct
  REGION 1..7: note = n-mer motif
ERSTHNV

SEQ ID NO: 7231 - protein, 7 aa, synthetic construct
  REGION 1..7: note = n-mer motif
MSGSMIS

SEQ ID NO: 7232 - protein, 7 aa, synthetic construct
  REGION 1..7: note = n-mer motif
SGQGFSA

SEQ ID NO: 7233 - protein, 7 aa, synthetic construct
  REGION 1..7: note = n-mer motif
TFTTLGK

SEQ ID NO: 7234 - protein, 7 aa, synthetic construct
  REGION 1..7: note = n-mer motif
DANAGTR

SEQ ID NO: 7235 - protein, 7 aa, synthetic construct
  REGION 1..7: note = n-mer motif
RDTAKGV

SEQ ID NO: 7236 - protein, 7 aa, synthetic construct
  REGION 1..7: note = n-mer motif
VRSGNKP

SEQ ID NO: 7237 - protein, 7 aa, synthetic construct
  REGION 1..7: note = n-mer motif
PQWGTDP

SEQ ID NO: 7238 - protein, 7 aa, synthetic construct
  REGION 1..7: note = n-mer motif
AFQNTGA

SEQ ID NO: 7239 - protein, 7 aa, synthetic construct
  REGION 1..7: note = n-mer motif
ATTQLMT

SEQ ID NO: 7240 - protein, 7 aa, synthetic construct
  REGION 1..7: note = n-mer motif
TNASEGS

SEQ ID NO: 7241 - protein, 7 aa, synthetic construct
  REGION 1..7: note = n-mer motif
MLTETKA

SEQ ID NO: 7242 - protein, 7 aa, synthetic construct
  REGION 1..7: note = n-mer motif
TNNLLAQ

SEQ ID NO: 7243 - protein, 7 aa, synthetic construct
  REGION 1..7: note = n-mer motif
DVLLKNF

SEQ ID NO: 7244 - protein, 7 aa, synthetic construct
  REGION 1..7: note = n-mer motif
YTPGLTE

SEQ ID NO: 7245 - protein, 7 aa, synthetic construct
  REGION 1..7: note = n-mer motif
RHASDAN

SEQ ID NO: 7246 - protein, 7 aa, synthetic construct
  REGION 1..7: note = n-mer motif
SKGDQLN

SEQ ID NO: 7247 - protein, 7 aa, synthetic construct
  REGION 1..7: note = n-mer motif
VLVTQNH

SEQ ID NO: 7248 - protein, 7 aa, synthetic construct
  REGION 1..7: note = n-mer motif
RQGDLKE

SEQ ID NO: 7249 - protein, 7 aa, synthetic construct
  REGION 1..7: note = n-mer motif
IQSQSQL

SEQ ID NO: 7250 - protein, 7 aa, synthetic construct
  REGION 1..7: note = n-mer motif
KIESGTI

SEQ ID NO: 7251 - protein, 7 aa, synthetic construct
  REGION 1..7: note = n-mer motif
TTLSQQS

SEQ ID NO: 7252 - protein, 7 aa, synthetic construct
  REGION 1..7: note = n-mer motif
FQLASNP

SEQ ID NO: 7253 - protein, 7 aa, synthetic construct
  REGION 1..7: note = n-mer motif
WISTEMR

SEQ ID NO: 7254 - protein, 7 aa, synthetic construct
  REGION 1..7: note = n-mer motif
AITITQK

SEQ ID NO: 7255 - protein, 7 aa, synthetic construct
  REGION 1..7: note = n-mer motif
VTGVDYA

SEQ ID NO: 7256 - protein, 7 aa, synthetic construct
  REGION 1..7: note = n-mer motif
IIASSTT

SEQ ID NO: 7257 - protein, 7 aa, synthetic construct
  REGION 1..7: note = n-mer motif
IYTNSHV

SEQ ID NO: 7258 - protein, 7 aa, synthetic construct
  REGION 1..7: note = n-mer motif
NDIPTRA

SEQ ID NO: 7259 - protein, 7 aa, synthetic construct
  REGION 1..7: note = n-mer motif
GVTNASK

SEQ ID NO: 7260 - protein, 7 aa, synthetic construct
  REGION 1..7: note = n-mer motif
RGNTLEM

SEQ ID NO: 7261 - protein, 7 aa, synthetic construct
  REGION 1..7: note = n-mer motif
GINHVAS

SEQ ID NO: 7262 - protein, 7 aa, synthetic construct
  REGION 1..7: note = n-mer motif
FNETAGR

SEQ ID NO: 7263 - protein, 7 aa, synthetic construct
  REGION 1..7: note = n-mer motif
ASQSEKN

SEQ ID NO: 7264 - protein, 7 aa, synthetic construct
  REGION 1..7: note = n-mer motif
ELNERNL

SEQ ID NO: 7265 - protein, 7 aa, synthetic construct
  REGION 1..7: note = n-mer motif
GEQSHNQ

SEQ ID NO: 7266 - protein, 7 aa, synthetic construct
  REGION 1..7: note = n-mer motif
LTNDNKL

SEQ ID NO: 7267 - protein, 7 aa, synthetic construct
  REGION 1..7: note = n-mer motif
SYGQGLE

SEQ ID NO: 7268 - protein, 7 aa, synthetic construct
  REGION 1..7: note = n-mer motif
HSDMGSS

SEQ ID NO: 7269 - protein, 7 aa, synthetic construct
  REGION 1..7: note = n-mer motif
ALKSDSA

SEQ ID NO: 7270 - protein, 7 aa, synthetic construct
  REGION 1..7: note = n-mer motif
TNLSPKT

SEQ ID NO: 7271 - protein, 7 aa, synthetic construct
  REGION 1..7: note = n-mer motif
ADTNIIV

SEQ ID NO: 7272 - protein, 7 aa, synthetic construct
  REGION 1..7: note = n-mer motif
SEGSSRS

SEQ ID NO: 7273 - protein, 7 aa, synthetic construct
  REGION 1..7: note = n-mer motif
NSSNTGW

SEQ ID NO: 7274 - protein, 7 aa, synthetic construct
  REGION 1..7: note = n-mer motif
VTNESRA

SEQ ID NO: 7275 - protein, 7 aa, synthetic construct
  REGION 1..7: note = n-mer motif
GRHTLAD

SEQ ID NO: 7276 - protein, 7 aa, synthetic construct
  REGION 1..7: note = n-mer motif
AVVNVAQ

SEQ ID NO: 7277 - protein, 6 aa, synthetic construct
  REGION 1..6: note = n-mer motif
KKPQQL

SEQ ID NO: 7278 - protein, 7 aa, synthetic construct
  REGION 1..7: note = n-mer motif
GNASGNP

SEQ ID NO: 7279 - protein, 7 aa, synthetic construct
  REGION 1..7: note = n-mer motif
FAAGAHG

SEQ ID NO: 7280 - protein, 7 aa, synthetic construct
  REGION 1..7: note = n-mer motif
GGNQNLT

SEQ ID NO: 7281 - protein, 7 aa, synthetic construct
  REGION 1..7: note = n-mer motif
HTQSTGY

SEQ ID NO: 7282 - protein, 7 aa, synthetic construct
  REGION 1..7: note = n-mer motif
LLGNAPT

SEQ ID NO: 7283 - protein, 7 aa, synthetic construct
  REGION 1..7: note = n-mer motif
EKGNSGV

SEQ ID NO: 7284 - protein, 7 aa, synthetic construct
  REGION 1..7: note = n-mer motif
GTEPRTA

SEQ ID NO: 7285 - protein, 7 aa, synthetic construct
  REGION 1..7: note = n-mer motif
MHAQESR

SEQ ID NO: 7286 - protein, 7 aa, synthetic construct
  REGION 1..7: note = n-mer motif
LISTGNN

SEQ ID NO: 7287 - protein, 7 aa, synthetic construct
  REGION 1..7: note = n-mer motif
KNNNSDS

SEQ ID NO: 7288 - protein, 7 aa, synthetic construct
  REGION 1..7: note = n-mer motif
GTLASMS

SEQ ID NO: 7289 - protein, 7 aa, synthetic construct
  REGION 1..7: note = n-mer motif
RIDTLLV

SEQ ID NO: 7290 - protein, 7 aa, synthetic construct
  REGION 1..7: note = n-mer motif
ISGSHLN

SEQ ID NO: 7291 - protein, 7 aa, synthetic construct
  REGION 1..7: note = n-mer motif
TVEGSYP

SEQ ID NO: 7292 - protein, 7 aa, synthetic construct
  REGION 1..7: note = n-mer motif
TEYLAGL

SEQ ID NO: 7293 - protein, 7 aa, synthetic construct
  REGION 1..7: note = n-mer motif
YLEGAHR

SEQ ID NO: 7294 - protein, 7 aa, synthetic construct
  REGION 1..7: note = n-mer motif
LSATSTM

SEQ ID NO: 7295 - protein, 7 aa, synthetic construct
  REGION 1..7: note = n-mer motif
MLSQVLT

SEQ ID NO: 7296 - protein, 7 aa, synthetic construct
  REGION 1..7: note = n-mer motif
ARNVMLG

SEQ ID NO: 7297 - protein, 7 aa, synthetic construct
  REGION 1..7: note = n-mer motif
LHGNFSQ

SEQ ID NO: 7298 - protein, 7 aa, synthetic construct
  REGION 1..7: note = n-mer motif
GHGSDLT

SEQ ID NO: 7299 - protein, 7 aa, synthetic construct
  REGION 1..7: note = n-mer motif
GVNYHTT

SEQ ID NO: 7300 - protein, 7 aa, synthetic construct
  REGION 1..7: note = n-mer motif
YLQTGTL

SEQ ID NO: 7301 - protein, 7 aa, synthetic construct
  REGION 1..7: note = n-mer motif
VNGGKPV

SEQ ID NO: 7302 - protein, 7 aa, synthetic construct
  REGION 1..7: note = n-mer motif
EVGKTTH

SEQ ID NO: 7303 - protein, 7 aa, synthetic construct
  REGION 1..7: note = n-mer motif
RPPNENR

SEQ ID NO: 7304 - protein, 7 aa, synthetic construct
  REGION 1..7: note = n-mer motif
VDKNHPL

SEQ ID NO: 7305 - protein, 7 aa, synthetic construct
  REGION 1..7: note = n-mer motif
SKSTEIM

SEQ ID NO: 7306 - protein, 7 aa, synthetic construct
  REGION 1..7: note = n-mer motif
TALLSNL

SEQ ID NO: 7307 - protein, 7 aa, synthetic construct
  REGION 1..7: note = n-mer motif
MHTSRPP

SEQ ID NO: 7308 - protein, 7 aa, synthetic construct
  REGION 1..7: note = n-mer motif
TPTNGNP

SEQ ID NO: 7309 - protein, 7 aa, synthetic construct
  REGION 1..7: note = n-mer motif
TTSVEKT

SEQ ID NO: 7310 - protein, 7 aa, synthetic construct
  REGION 1..7: note = n-mer motif
QYDASRQ

SEQ ID NO: 7311 - protein, 7 aa, synthetic construct
  REGION 1..7: note = n-mer motif
YNAHESF

SEQ ID NO: 7312 - protein, 7 aa, synthetic construct
  REGION 1..7: note = n-mer motif
DNQQALA

SEQ ID NO: 7313 - protein, 7 aa, synthetic construct
  REGION 1..7: note = n-mer motif
TKSFNDL

SEQ ID NO: 7314 - protein, 7 aa, synthetic construct
  REGION 1..7: note = n-mer motif
LADSNSK

SEQ ID NO: 7315 - protein, 7 aa, synthetic construct
  REGION 1..7: note = n-mer motif
PSTHGYV

SEQ ID NO: 7316 - protein, 7 aa, synthetic construct
  REGION 1..7: note = n-mer motif
QVQGTLG

SEQ ID NO: 7317 - protein, 7 aa, synthetic construct
  REGION 1..7: note = n-mer motif
LTAVAIS

SEQ ID NO: 7318 - protein, 7 aa, synthetic construct
  REGION 1..7: note = n-mer motif
RYESTSA

SEQ ID NO: 7319 - protein, 7 aa, synthetic construct
  REGION 1..7: note = n-mer motif
ADHNHIA

SEQ ID NO: 7320 - protein, 7 aa, synthetic construct
  REGION 1..7: note = n-mer motif
WNAENSK

SEQ ID NO: 7321 - protein, 7 aa, synthetic construct
  REGION 1..7: note = n-mer motif
NSVVGNI

SEQ ID NO: 7322 - protein, 7 aa, synthetic construct
  REGION 1..7: note = n-mer motif
FGATTTA

SEQ ID NO: 7323 - protein, 7 aa, synthetic construct
  REGION 1..7: note = n-mer motif
ASGSEMP

SEQ ID NO: 7324 - protein, 7 aa, synthetic construct
  REGION 1..7: note = n-mer motif
DGTKSGM

SEQ ID NO: 7325 - protein, 7 aa, synthetic construct
  REGION 1..7: note = n-mer motif
YTADKKQ

SEQ ID NO: 7326 - protein, 7 aa, synthetic construct
  REGION 1..7: note = n-mer motif
PIAERPS

SEQ ID NO: 7327 - protein, 7 aa, synthetic construct
  REGION 1..7: note = n-mer motif
SNSYLLN

SEQ ID NO: 7328 - protein, 7 aa, synthetic construct
  REGION 1..7: note = n-mer motif
TRELTKN

SEQ ID NO: 7329 - protein, 7 aa, synthetic construct
  REGION 1..7: note = n-mer motif
LGNHYTP

SEQ ID NO: 7330 - protein, 7 aa, synthetic construct
  REGION 1..7: note = n-mer motif
LLQSIVV

SEQ ID NO: 7331 - protein, 7 aa, synthetic construct
  REGION 1..7: note = n-mer motif
MMANNMQ

SEQ ID NO: 7332 - protein, 7 aa, synthetic construct
  REGION 1..7: note = n-mer motif
GADTSTR

SEQ ID NO: 7333 - protein, 7 aa, synthetic construct
  REGION 1..7: note = n-mer motif
GFGHVPE

SEQ ID NO: 7334 - protein, 7 aa, synthetic construct
  REGION 1..7: note = n-mer motif
NVMHSSS

SEQ ID NO: 7335 - protein, 7 aa, synthetic construct
  REGION 1..7: note = n-mer motif
SASKVEY

SEQ ID NO: 7336 - protein, 7 aa, synthetic construct
  REGION 1..7: note = n-mer motif
ISSYDGN

SEQ ID NO: 7337 - protein, 7 aa, synthetic construct
  REGION 1..7: note = n-mer motif
KKTKTLT

SEQ ID NO: 7338 - protein, 7 aa, synthetic construct
  REGION 1..7: note = n-mer motif
GTILPNQ

SEQ ID NO: 7339 - protein, 7 aa, synthetic construct
  REGION 1..7: note = n-mer motif
LNVVPTQ

SEQ ID NO: 7340 - protein, 7 aa, synthetic construct
  REGION 1..7: note = n-mer motif
SSVTSRE

SEQ ID NO: 7341 - protein, 7 aa, synthetic construct
  REGION 1..7: note = n-mer motif
PINVLTT

SEQ ID NO: 7342 - protein, 7 aa, synthetic construct
  REGION 1..7: note = n-mer motif
GDKASLA

SEQ ID NO: 7343 - protein, 7 aa, synthetic construct
  REGION 1..7: note = n-mer motif
RMSESSD

SEQ ID NO: 7344 - protein, 7 aa, synthetic construct
  REGION 1..7: note = n-mer motif
NLLTSSP

SEQ ID NO: 7345 - protein, 7 aa, synthetic construct
  REGION 1..7: note = n-mer motif
SRLSQDP

SEQ ID NO: 7346 - protein, 7 aa, synthetic construct
  REGION 1..7: note = n-mer motif
WSNAQSP

SEQ ID NO: 7347 - protein, 7 aa, synthetic construct
  REGION 1..7: note = n-mer motif
GRHLQSD

SEQ ID NO: 7348 - protein, 7 aa, synthetic construct
  REGION 1..7: note = n-mer motif
MSLASTQ

SEQ ID NO: 7349 - protein, 7 aa, synthetic construct
  REGION 1..7: note = n-mer motif
MSTVLRE

SEQ ID NO: 7350 - protein, 7 aa, synthetic construct
  REGION 1..7: note = n-mer motif
SKSENLQ

SEQ ID NO: 7351 - protein, 7 aa, synthetic construct
  REGION 1..7: note = n-mer motif
WTEGGSG

SEQ ID NO: 7352 - protein, 7 aa, synthetic construct
  REGION 1..7: note = n-mer motif
STTVWTA

SEQ ID NO: 7353 - protein, 7 aa, synthetic construct
  REGION 1..7: note = n-mer motif
VSLESRL

SEQ ID NO: 7354 - protein, 7 aa, synthetic construct
  REGION 1..7: note = n-mer motif
SMYGQAG

SEQ ID NO: 7355 - protein, 7 aa, synthetic construct
  REGION 1..7: note = n-mer motif
TNTQNNP

SEQ ID NO: 7356 - protein, 7 aa, synthetic construct
  REGION 1..7: note = n-mer motif
VGDRNLV

SEQ ID NO: 7357 - protein, 7 aa, synthetic construct
  REGION 1..7: note = n-mer motif
LAHNYLS

SEQ ID NO: 7358 - protein, 7 aa, synthetic construct
  REGION 1..7: note = n-mer motif
WTANQGL

SEQ ID NO: 7359 - protein, 7 aa, synthetic construct
  REGION 1..7: note = n-mer motif
VFREGIV

SEQ ID NO: 7360 - protein, 7 aa, synthetic construct
  REGION 1..7: note = n-mer motif
QVQHERV

SEQ ID NO: 7361 - protein, 7 aa, synthetic construct
  REGION 1..7: note = n-mer motif
QILNYSV

SEQ ID NO: 7362 - protein, 7 aa, synthetic construct
  REGION 1..7: note = n-mer motif
STIGNST

SEQ ID NO: 7363 - protein, 7 aa, synthetic construct
  REGION 1..7: note = n-mer motif
PIHHGSS

SEQ ID NO: 7364 - protein, 7 aa, synthetic construct
  REGION 1..7: note = n-mer motif
IATNVIY

SEQ ID NO: 7365 - protein, 7 aa, synthetic construct
  REGION 1..7: note = n-mer motif
QGGTNNP

SEQ ID NO: 7366 - protein, 7 aa, synthetic construct
  REGION 1..7: note = n-mer motif
TRGNDIS

SEQ ID NO: 7367 - protein, 7 aa, synthetic construct
  REGION 1..7: note = n-mer motif
QTLIVGS

SEQ ID NO: 7368 - protein, 7 aa, synthetic construct
  REGION 1..7: note = n-mer motif
RGLPDVN

SEQ ID NO: 7369 - protein, 7 aa, synthetic construct
  REGION 1..7: note = n-mer motif
LNVNTLN

SEQ ID NO: 7370 - protein, 7 aa, synthetic construct
  REGION 1..7: note = n-mer motif
GTKSWPV

SEQ ID NO: 7371 - protein, 7 aa, synthetic construct
  REGION 1..7: note = n-mer motif
THLVSDS

SEQ ID NO: 7372 - protein, 7 aa, synthetic construct
  REGION 1..7: note = n-mer motif
WTGAQPS

SEQ ID NO: 7373 - protein, 7 aa, synthetic construct
  REGION 1..7: note = n-mer motif
SAMHTLV

SEQ ID NO: 7374 - protein, 7 aa, synthetic construct
  REGION 1..7: note = n-mer motif
SQHHTPL

SEQ ID NO: 7375 - protein, 7 aa, synthetic construct
  REGION 1..7: note = n-mer motif
DNRMEAT

SEQ ID NO: 7376 - protein, 7 aa, synthetic construct
  REGION 1..7: note = n-mer motif
LGGTLGI

SEQ ID NO: 7377 - protein, 7 aa, synthetic construct
  REGION 1..7: note = n-mer motif
FHNESYG

SEQ ID NO: 7378 - protein, 7 aa, synthetic construct
  REGION 1..7: note = n-mer motif
IRTSVIN

SEQ ID NO: 7379 - protein, 7 aa, synthetic construct
  REGION 1..7: note = n-mer motif
YNTVDQR

SEQ ID NO: 7380 - protein, 7 aa, synthetic construct
  REGION 1..7: note = n-mer motif
AHQTAGP

SEQ ID NO: 7381 - protein, 7 aa, synthetic construct
  REGION 1..7: note = n-mer motif
PPESARG

SEQ ID NO: 7382 - protein, 7 aa, synthetic construct
  REGION 1..7: note = n-mer motif
NNTLNIL

SEQ ID NO: 7383 - protein, 7 aa, synthetic construct
  REGION 1..7: note = n-mer motif
ASYSSMV

SEQ ID NO: 7384 - protein, 7 aa, synthetic construct
  REGION 1..7: note = n-mer motif
SGQNGTS

SEQ ID NO: 7385 - protein, 7 aa, synthetic construct
  REGION 1..7: note = n-mer motif
LSSMSTD

SEQ ID NO: 7386 - protein, 7 aa, synthetic construct
  REGION 1..7: note = n-mer motif
VASMVHN

SEQ ID NO: 7387 - protein, 7 aa, synthetic construct
  REGION 1..7: note = n-mer motif
TQLSDGC

SEQ ID NO: 7388 - protein, 7 aa, synthetic construct
  REGION 1..7: note = n-mer motif
AIVDRGS

SEQ ID NO: 7389 - protein, 7 aa, synthetic construct
  REGION 1..7: note = n-mer motif
NRQRDFE

SEQ ID NO: 7390 - protein, 7 aa, synthetic construct
  REGION 1..7: note = n-mer motif
AHQKDIR

SEQ ID NO: 7391 - protein, 7 aa, synthetic construct
  REGION 1..7: note = n-mer motif
FTERALQ

SEQ ID NO: 7392 - protein, 7 aa, synthetic construct
  REGION 1..7: note = n-mer motif
MLSHGAL

SEQ ID NO: 7393 - protein, 7 aa, synthetic construct
  REGION 1..7: note = n-mer motif
SVTNGAE

SEQ ID NO: 7394 - protein, 7 aa, synthetic construct
  REGION 1..7: note = n-mer motif
ITAASPQ

SEQ ID NO: 7395 - protein, 7 aa, synthetic construct
  REGION 1..7: note = n-mer motif
QNTQRYL

SEQ ID NO: 7396 - protein, 7 aa, synthetic construct
  REGION 1..7: note = n-mer motif
TGQGFSA

SEQ ID NO: 7397 - protein, 7 aa, synthetic construct
  REGION 1..7: note = n-mer motif
SFEKNGI

SEQ ID NO: 7398 - protein, 7 aa, synthetic construct
  REGION 1..7: note = n-mer motif
LTSHSAG

SEQ ID NO: 7399 - protein, 7 aa, synthetic construct
  REGION 1..7: note = n-mer motif
STIGNST

SEQ ID NO: 7400 - protein, 7 aa, synthetic construct
  REGION 1..7: note = n-mer motif
GLSRNDG

SEQ ID NO: 7401 - protein, 7 aa, synthetic construct
  REGION 1..7: note = n-mer motif
STTHPSE

SEQ ID NO: 7402 - protein, 7 aa, synthetic construct
  REGION 1..7: note = n-mer motif
PSTNESR

SEQ ID NO: 7403 - protein, 7 aa, synthetic construct
  REGION 1..7: note = n-mer motif
GTKDILI

SEQ ID NO: 7404 - protein, 7 aa, synthetic construct
  REGION 1..7: note = n-mer motif
STINMRA

SEQ ID NO: 7405 - protein, 7 aa, synthetic construct
  REGION 1..7: note = n-mer motif
YIAGGEQ

SEQ ID NO: 7406 - protein, 7 aa, synthetic construct
  REGION 1..7: note = n-mer motif
SSGQPLV

SEQ ID NO: 7407 - protein, 7 aa, synthetic construct
  REGION 1..7: note = n-mer motif
DKQQTGQ

SEQ ID NO: 7408 - protein, 7 aa, synthetic construct
  REGION 1..7: note = n-mer motif
GLGQPQL

SEQ ID NO: 7409 - protein, 7 aa, synthetic construct
  REGION 1..7: note = n-mer motif
SPQHGVI

SEQ ID NO: 7410 - protein, 7 aa, synthetic construct
  REGION 1..7: note = n-mer motif
YRGREDW

SEQ ID NO: 7411 - protein, 7 aa, synthetic construct
  REGION 1..7: note = n-mer motif
AGGLLSR

SEQ ID NO: 7412 - protein, 7 aa, synthetic construct
  REGION 1..7: note = n-mer motif
PIQQASL

SEQ ID NO: 7413 - protein, 7 aa, synthetic construct
  REGION 1..7: note = n-mer motif
WSAGERV

SEQ ID NO: 7414 - protein, 7 aa, synthetic construct
  REGION 1..7: note = n-mer motif
RGDVATT

SEQ ID NO: 7415 - protein, 7 aa, synthetic construct
  REGION 1..7: note = n-mer motif
LTGQNEF

SEQ ID NO: 7416 - protein, 7 aa, synthetic construct
  REGION 1..7: note = n-mer motif
TTPPFSN

SEQ ID NO: 7417 - protein, 7 aa, synthetic construct
  REGION 1..7: note = n-mer motif
TSIGSAK

SEQ ID NO: 7418 - protein, 7 aa, synthetic construct
  REGION 1..7: note = n-mer motif
NVQNVPG

SEQ ID NO: 7419 - protein, 7 aa, synthetic construct
  REGION 1..7: note = n-mer motif
YTGTLVV

SEQ ID NO: 7420 - protein, 7 aa, synthetic construct
  REGION 1..7: note = n-mer motif
GTHASAY

SEQ ID NO: 7421 - protein, 7 aa, synthetic construct
  REGION 1..7: note = n-mer motif
LVVSNSL

SEQ ID NO: 7422 - protein, 7 aa, synthetic construct
  REGION 1..7: note = n-mer motif
THLVRDS

SEQ ID NO: 7423 - protein, 7 aa, synthetic construct
  REGION 1..7: note = n-mer motif
NHGRAID

SEQ ID NO: 7424 - protein, 7 aa, synthetic construct
  REGION 1..7: note = n-mer motif
PKTLTST

SEQ ID NO: 7425 - protein, 7 aa, synthetic construct
  REGION 1..7: note = n-mer motif
FGIGHGT

SEQ ID NO: 7426 - protein, 7 aa, synthetic construct
  REGION 1..7: note = n-mer motif
ALPSRER

SEQ ID NO: 7427 - protein, 7 aa, synthetic construct
  REGION 1..7: note = n-mer motif
ATRGESS

SEQ ID NO: 7428 - protein, 7 aa, synthetic construct
  REGION 1..7: note = n-mer motif
GTTEVNK

SEQ ID NO: 7429 - protein, 7 aa, synthetic construct
  REGION 1..7: note = n-mer motif
THTLGGT

SEQ ID NO: 7430 - protein, 7 aa, synthetic construct
  REGION 1..7: note = n-mer motif
EAVTSKW

SEQ ID NO: 7431 - protein, 7 aa, synthetic construct
  REGION 1..7: note = n-mer motif
HYGNKDI

SEQ ID NO: 7432 - protein, 7 aa, synthetic construct
  REGION 1..7: note = n-mer motif
ISTHTMT

SEQ ID NO: 7433 - protein, 7 aa, synthetic construct
  REGION 1..7: note = n-mer motif
DTYNSNT

SEQ ID NO: 7434 - protein, 7 aa, synthetic construct
  REGION 1..7: note = n-mer motif
VFTGQTE

SEQ ID NO: 7435 - protein, 7 aa, synthetic construct
  REGION 1..7: note = n-mer motif
SVTSGTQ

SEQ ID NO: 7436 - protein, 7 aa, synthetic construct
  REGION 1..7: note = n-mer motif
HTYSQAD

SEQ ID NO: 7437 - protein, 7 aa, synthetic construct
  REGION 1..7: note = n-mer motif
VAGLVDI

SEQ ID NO: 7438 - protein, 7 aa, synthetic construct
  REGION 1..7: note = n-mer motif
DSTKAMQ

SEQ ID NO: 7439 - protein, 7 aa, synthetic construct
  REGION 1..7: note = n-mer motif
EGHNRGI

SEQ ID NO: 7440 - protein, 7 aa, synthetic construct
  REGION 1..7: note = n-mer motif
GLHGTSN

SEQ ID NO: 7441 - protein, 7 aa, synthetic construct
  REGION 1..7: note = n-mer motif
PLSLHNS

SEQ ID NO: 7442 - protein, 7 aa, synthetic construct
  REGION 1..7: note = n-mer motif
ASDKGAN

SEQ ID NO: 7443 - protein, 7 aa, synthetic construct
  REGION 1..7: note = n-mer motif
VLLQNSH

SEQ ID NO: 7444 - protein, 7 aa, synthetic construct
  REGION 1..7: note = n-mer motif
LYDGKHV

SEQ ID NO: 7445 - protein, 7 aa, synthetic construct
  REGION 1..7: note = n-mer motif
TQGSNTT

SEQ ID NO: 7446 - protein, 7 aa, synthetic construct
  REGION 1..7: note = n-mer motif
FLDKYNY

SEQ ID NO: 7447 - protein, 7 aa, synthetic construct
  REGION 1..7: note = n-mer motif
DTGIKNV

SEQ ID NO: 7448 - protein, 7 aa, synthetic construct
  REGION 1..7: note = n-mer motif
SGAAQNP

SEQ ID NO: 7449 - protein, 7 aa, synthetic construct
  REGION 1..7: note = n-mer motif
TLHTKDL

SEQ ID NO: 7450 - protein, 7 aa, synthetic construct
  REGION 1..7: note = n-mer motif
ATYVVGT

SEQ ID NO: 7451 - protein, 7 aa, synthetic construct
  REGION 1..7: note = n-mer motif
LVGTLVY

SEQ ID NO: 7452 - protein, 7 aa, synthetic construct
  REGION 1..7: note = n-mer motif
SNTTVQL

SEQ ID NO: 7453 - protein, 7 aa, synthetic construct
  REGION 1..7: note = n-mer motif
KAQINQM

SEQ ID NO: 7454 - protein, 7 aa, synthetic construct
  REGION 1..7: note = n-mer motif
RNATVTV

SEQ ID NO: 7455 - protein, 7 aa, synthetic construct
  REGION 1..7: note = n-mer motif
ATRVGNH

SEQ ID NO: 7456 - protein, 7 aa, synthetic construct
  REGION 1..7: note = n-mer motif
SYQNPPP

SEQ ID NO: 7457 - protein, 7 aa, synthetic construct
  REGION 1..7: note = n-mer motif
FDSYNIV

SEQ ID NO: 7458 - protein, 7 aa, synthetic construct
  REGION 1..7: note = n-mer motif
ATLSPHA

SEQ ID NO: 7459 - protein, 7 aa, synthetic construct
  REGION 1..7: note = n-mer motif
WESPTNA

SEQ ID NO: 7460 - protein, 7 aa, synthetic construct
  REGION 1..7: note = n-mer motif
IENVNHL

SEQ ID NO: 7461 - protein, 7 aa, synthetic construct
  REGION 1..7: note = n-mer motif
YRASDVA

SEQ ID NO: 7462 - protein, 7 aa, synthetic construct
  REGION 1..7: note = n-mer motif
HMSSVAT

SEQ ID NO: 7463 - protein, 7 aa, synthetic construct
  REGION 1..7: note = n-mer motif
IQRDVGH

SEQ ID NO: 7464 - protein, 7 aa, synthetic construct
  REGION 1..7: note = n-mer motif
ESVRETI

SEQ ID NO: 7465 - protein, 7 aa, synthetic construct
  REGION 1..7: note = n-mer motif
QGGNSRF

SEQ ID NO: 7466 - protein, 7 aa, synthetic construct
  REGION 1..7: note = n-mer motif
EKGTPSS

SEQ ID NO: 7467 - protein, 7 aa, synthetic construct
  REGION 1..7: note = n-mer motif
HDSTTRP

SEQ ID NO: 7468 - protein, 7 aa, synthetic construct
  REGION 1..7: note = n-mer motif
LPTGVLP

SEQ ID NO: 7469 - protein, 7 aa, synthetic construct
  REGION 1..7: note = n-mer motif
TLGYPDK

SEQ ID NO: 7470 - protein, 7 aa, synthetic construct
  REGION 1..7: note = n-mer motif
ANTVTER

SEQ ID NO: 7471 - protein, 7 aa, synthetic construct
  REGION 1..7: note = n-mer motif
HDKSIQP

SEQ ID NO: 7472 - protein, 7 aa, synthetic construct
  REGION 1..7: note = n-mer motif
GGTALGS

SEQ ID NO: 7473 - protein, 7 aa, synthetic construct
  REGION 1..7: note = n-mer motif
GGNYHTT

SEQ ID NO: 7474 - protein, 7 aa, synthetic construct
  REGION 1..7: note = n-mer motif
ISEMTRY

SEQ ID NO: 7475 - protein, 7 aa, synthetic construct
  REGION 1..7: note = n-mer motif
VESKSEP

SEQ ID NO: 7476 - protein, 7 aa, synthetic construct
  REGION 1..7: note = n-mer motif
DRAQNNE

SEQ ID NO: 7477 - protein, 7 aa, synthetic construct
  REGION 1..7: note = n-mer motif
TAQTGWV

SEQ ID NO: 7478 - protein, 7 aa, synthetic construct
  REGION 1..7: note = n-mer motif
GFGHLPE

SEQ ID NO: 7479 - protein, 7 aa, synthetic construct
  REGION 1..7: note = n-mer motif
PITGFSV

SEQ ID NO: 7480 - protein, 7 aa, synthetic construct
  REGION 1..7: note = n-mer motif
DRTYSNT

SEQ ID NO: 7481 - protein, 7 aa, synthetic construct
  REGION 1..7: note = n-mer motif
MSNASYI

SEQ ID NO: 7482 - protein, 7 aa, synthetic construct
  REGION 1..7: note = n-mer motif
DNSRPEV

SEQ ID NO: 7483 - protein, 7 aa, synthetic construct
  REGION 1..7: note = n-mer motif
SSSQTVL

SEQ ID NO: 7484 - protein, 7 aa, synthetic construct
  REGION 1..7: note = n-mer motif
SNLDGTI

SEQ ID NO: 7485 - protein, 7 aa, synthetic construct
  REGION 1..7: note = n-mer motif
SNMREEI

SEQ ID NO: 7486 - protein, 7 aa, synthetic construct
  REGION 1..7: note = n-mer motif
RLTELVI

SEQ ID NO: 7487 - protein, 7 aa, synthetic construct
  REGION 1..7: note = n-mer motif
QVSLVKL

SEQ ID NO: 7488 - protein, 7 aa, synthetic construct
  REGION 1..7: note = n-mer motif
EIHTTTG

SEQ ID NO: 7489 - protein, 7 aa, synthetic construct
  REGION 1..7: note = n-mer motif
SRIENNN

SEQ ID NO: 7490 - protein, 7 aa, synthetic construct
  REGION 1..7: note = n-mer motif
GTGKEVR

SEQ ID NO: 7491 - protein, 7 aa, synthetic construct
  REGION 1..7: note = n-mer motif
WQDHNKV

SEQ ID NO: 7492 - protein, 7 aa, synthetic construct
  REGION 1..7: note = n-mer motif
STNSIGA

SEQ ID NO: 7493 - protein, 7 aa, synthetic construct
  REGION 1..7: note = n-mer motif
SELMVRP

SEQ ID NO: 7494 - protein, 7 aa, synthetic construct
  REGION 1..7: note = n-mer motif
PLQNNKT

SEQ ID NO: 7495 - protein, 7 aa, synthetic construct
  REGION 1..7: note = n-mer motif
PYANRLE

SEQ ID NO: 7496 - protein, 7 aa, synthetic construct
  REGION 1..7: note = n-mer motif
GTVSLIP

SEQ ID NO: 7497 - protein, 7 aa, synthetic construct
  REGION 1..7: note = n-mer motif
DVYLKSP

SEQ ID NO: 7498 - protein, 7 aa, synthetic construct
  REGION 1..7: note = n-mer motif
LPDKGRI

SEQ ID NO: 7499 - protein, 7 aa, synthetic construct
  REGION 1..7: note = n-mer motif
SITTVAN

SEQ ID NO: 7500 - protein, 7 aa, synthetic construct
  REGION 1..7: note = n-mer motif
PLQSQSG

SEQ ID NO: 7501 - protein, 7 aa, synthetic construct
  REGION 1..7: note = n-mer motif
NNMGHGH

SEQ ID NO: 7502 - protein, 7 aa, synthetic construct
  REGION 1..7: note = n-mer motif
SGQKNSE

SEQ ID NO: 7503 - protein, 7 aa, synthetic construct
  REGION 1..7: note = n-mer motif
TEAGRPQ

SEQ ID NO: 7504 - protein, 7 aa, synthetic construct
  REGION 1..7: note = n-mer motif
TLHTKDL

SEQ ID NO: 7505 - protein, 7 aa, synthetic construct
  REGION 1..7: note = n-mer motif
LRDLNGG

SEQ ID NO: 7506 - protein, 7 aa, synthetic construct
  REGION 1..7: note = n-mer motif
VCVTTCA

SEQ ID NO: 7507 - protein, 7 aa, synthetic construct
  REGION 1..7: note = n-mer motif
VTAAQPQ

SEQ ID NO: 7508 - protein, 7 aa, synthetic construct
  REGION 1..7: note = n-mer motif
ATFSHAG

SEQ ID NO: 7509 - protein, 7 aa, synthetic construct
  REGION 1..7: note = n-mer motif
TYAPRSP

SEQ ID NO: 7510 - protein, 7 aa, synthetic construct
  REGION 1..7: note = n-mer motif
TSEMRTA

SEQ ID NO: 7511 - protein, 7 aa, synthetic construct
  REGION 1..7: note = n-mer motif
YSTTMLN

SEQ ID NO: 7512 - protein, 7 aa, synthetic construct
  REGION 1..7: note = n-mer motif
SFTNTNP

SEQ ID NO: 7513 - protein, 7 aa, synthetic construct
  REGION 1..7: note = n-mer motif
SPPSTSG

SEQ ID NO: 7514 - protein, 7 aa, synthetic construct
  REGION 1..7: note = n-mer motif
VTTVDSA

SEQ ID NO: 7515 - protein, 7 aa, synthetic construct
  REGION 1..7: note = n-mer motif
EAHNRVI

SEQ ID NO: 7516 - protein, 7 aa, synthetic construct
  REGION 1..7: note = n-mer motif
MELTSTS

SEQ ID NO: 7517 - protein, 7 aa, synthetic construct
  REGION 1..7: note = n-mer motif
HLVTSGI

SEQ ID NO: 7518 - protein, 7 aa, synthetic construct
  REGION 1..7: note = n-mer motif
QTITSQM

SEQ ID NO: 7519 - protein, 7 aa, synthetic construct
  REGION 1..7: note = n-mer motif
TANSTYV

SEQ ID NO: 7520 - protein, 7 aa, synthetic construct
  REGION 1..7: note = n-mer motif
LIQLSGQ

SEQ ID NO: 7521 - protein, 7 aa, synthetic construct
  REGION 1..7: note = n-mer motif
SYVSVPA

SEQ ID NO: 7522 - protein, 7 aa, synthetic construct
  REGION 1..7: note = n-mer motif
VHGNAPA

SEQ ID NO: 7523 - protein, 7 aa, synthetic construct
  REGION 1..7: note = n-mer motif
AGKTHAD

SEQ ID NO: 7524 - protein, 7 aa, synthetic construct
  REGION 1..7: note = n-mer motif
TFHQGVK

SEQ ID NO: 7525 - protein, 7 aa, synthetic construct
  REGION 1..7: note = n-mer motif
LGNNRPL

SEQ ID NO: 7526 - protein, 7 aa, synthetic construct
  REGION 1..7: note = n-mer motif
LHLVRSF

SEQ ID NO: 7527 - protein, 7 aa, synthetic construct
  REGION 1..7: note = n-mer motif
SYSTSTP

SEQ ID NO: 7528 - protein, 7 aa, synthetic construct
  REGION 1..7: note = n-mer motif
ISQGSSL

SEQ ID NO: 7529 - protein, 7 aa, synthetic construct
  REGION 1..7: note = n-mer motif
LQLATSH

SEQ ID NO: 7530 - protein, 7 aa, synthetic construct
  REGION 1..7: note = n-mer motif
VTQRFAE

SEQ ID NO: 7531 - protein, 7 aa, synthetic construct
  REGION 1..7: note = n-mer motif
AIDSIKM

SEQ ID NO: 7532 - protein, 7 aa, synthetic construct
  REGION 1..7: note = n-mer motif
DAHTFSR

SEQ ID NO: 7533 - protein, 7 aa, synthetic construct
  REGION 1..7: note = n-mer motif
RGSDGGL

SEQ ID NO: 7534 - protein, 7 aa, synthetic construct
  REGION 1..7: note = n-mer motif
LAQGTDR

SEQ ID NO: 7535 - protein, 7 aa, synthetic construct
  REGION 1..7: note = n-mer motif
KNNNSDS

SEQ ID NO: 7536 - protein, 7 aa, synthetic construct
  REGION 1..7: note = n-mer motif
ENEKRES

SEQ ID NO: 7537 - protein, 7 aa, synthetic construct
  REGION 1..7: note = n-mer motif
NEQFEKV

SEQ ID NO: 7538 - protein, 7 aa, synthetic construct
  REGION 1..7: note = n-mer motif
TQVVART

SEQ ID NO: 7539 - protein, 7 aa, synthetic construct
  REGION 1..7: note = n-mer motif
GVNVTNS

SEQ ID NO: 7540 - protein, 7 aa, synthetic construct
  REGION 1..7: note = n-mer motif
ADKGFGH

SEQ ID NO: 7541 - protein, 7 aa, synthetic construct
  REGION 1..7: note = n-mer motif
THKQVDL

SEQ ID NO: 7542 - protein, 7 aa, synthetic construct
  REGION 1..7: note = n-mer motif
SANLYKQ

SEQ ID NO: 7543 - protein, 7 aa, synthetic construct
  REGION 1..7: note = n-mer motif
KLHTKDL

SEQ ID NO: 7544 - protein, 7 aa, synthetic construct
  REGION 1..7: note = n-mer motif
VVVHTIP

SEQ ID NO: 7545 - protein, 7 aa, synthetic construct
  REGION 1..7: note = n-mer motif
STSQAVQ

SEQ ID NO: 7546 - protein, 7 aa, synthetic construct
  REGION 1..7: note = n-mer motif
RNGSAQS

SEQ ID NO: 7547 - protein, 7 aa, synthetic construct
  REGION 1..7: note = n-mer motif
HYGNKDI

SEQ ID NO: 7548 - protein, 7 aa, synthetic construct
  REGION 1..7: note = n-mer motif
SFLVAHP

SEQ ID NO: 7549 - protein, 7 aa, synthetic construct
  REGION 1..7: note = n-mer motif
QQNTSLP

SEQ ID NO: 7550 - protein, 7 aa, synthetic construct
  REGION 1..7: note = n-mer motif
MHVDKTS

SEQ ID NO: 7551 - protein, 7 aa, synthetic construct
  REGION 1..7: note = n-mer motif
NNENTRN

SEQ ID NO: 7552 - protein, 7 aa, synthetic construct
  REGION 1..7: note = n-mer motif
SINNIGA

SEQ ID NO: 7553 - protein, 7 aa, synthetic construct
  REGION 1..7: note = n-mer motif
ATISDRA

SEQ ID NO: 7554 - protein, 7 aa, synthetic construct
  REGION 1..7: note = n-mer motif
YSNLVLS

SEQ ID NO: 7555 - protein, 7 aa, synthetic construct
  REGION 1..7: note = n-mer motif
MMNVSGH

SEQ ID NO: 7556 - protein, 7 aa, synthetic construct
  REGION 1..7: note = n-mer motif
GETRSTA

SEQ ID NO: 7557 - protein, 7 aa, synthetic construct
  REGION 1..7: note = n-mer motif
TKGYNDL

SEQ ID NO: 7558 - protein, 7 aa, synthetic construct
  REGION 1..7: note = n-mer motif
AYNMSSV

SEQ ID NO: 7559 - protein, 7 aa, synthetic construct
  REGION 1..7: note = n-mer motif
ADPAKGK

SEQ ID NO: 7560 - protein, 7 aa, synthetic construct
  REGION 1..7: note = n-mer motif
YISAPPM

SEQ ID NO: 7561 - protein, 7 aa, synthetic construct
  REGION 1..7: note = n-mer motif
RNNPSHD

SEQ ID NO: 7562 - protein, 7 aa, synthetic construct
  REGION 1..7: note = n-mer motif
GTSIDYV

SEQ ID NO: 7563 - protein, 7 aa, synthetic construct
  REGION 1..7: note = n-mer motif
GTGYPNQ

SEQ ID NO: 7564 - protein, 7 aa, synthetic construct
  REGION 1..7: note = n-mer motif
DHMNLRS

SEQ ID NO: 7565 - protein, 7 aa, synthetic construct
  REGION 1..7: note = n-mer motif
INSYLHE

SEQ ID NO: 7566 - protein, 7 aa, synthetic construct
  REGION 1..7: note = n-mer motif
WQMGAGS

SEQ ID NO: 7567 - protein, 7 aa, synthetic construct
  REGION 1..7: note = n-mer motif
MGIGSYK

SEQ ID NO: 7568 - protein, 7 aa, synthetic construct
  REGION 1..7: note = n-mer motif
QNHNELK

SEQ ID NO: 7569 - protein, 7 aa, synthetic construct
  REGION 1..7: note = n-mer motif
DKSNYSI

SEQ ID NO: 7570 - protein, 7 aa, synthetic construct
  REGION 1..7: note = n-mer motif
TTKPVAE

SEQ ID NO: 7571 - protein, 7 aa, synthetic construct
  REGION 1..7: note = n-mer motif
VTVSNSL

SEQ ID NO: 7572 - protein, 7 aa, synthetic construct
  REGION 1..7: note = n-mer motif
TAYLDGL

SEQ ID NO: 7573 - protein, 7 aa, synthetic construct
  REGION 1..7: note = n-mer motif
NLQTGVQ

SEQ ID NO: 7574 - protein, 7 aa, synthetic construct
  REGION 1..7: note = n-mer motif
TVAPYSS

SEQ ID NO: 7575 - protein, 7 aa, synthetic construct
  REGION 1..7: note = n-mer motif
VQISMNN

SEQ ID NO: 7576 - protein, 7 aa, synthetic construct
  REGION 1..7: note = n-mer motif
YIAGGEQ

SEQ ID NO: 7577 - protein, 7 aa, synthetic construct
  REGION 1..7: note = n-mer motif
FMEVMKN

SEQ ID NO: 7578 - protein, 7 aa, synthetic construct
  REGION 1..7: note = n-mer motif
TTDKGIN

SEQ ID NO: 7579 - protein, 7 aa, synthetic construct
  REGION 1..7: note = n-mer motif
LSYSIQH

SEQ ID NO: 7580 - protein, 7 aa, synthetic construct
  REGION 1..7: note = n-mer motif
AYNARLP

SEQ ID NO: 7581 - protein, 7 aa, synthetic construct
  REGION 1..7: note = n-mer motif
NTGTTSV

SEQ ID NO: 7582 - protein, 7 aa, synthetic construct
  REGION 1..7: note = n-mer motif
VLSTGLR

SEQ ID NO: 7583 - protein, 7 aa, synthetic construct
  REGION 1..7: note = n-mer motif
NDSSSMS

SEQ ID NO: 7584 - protein, 7 aa, synthetic construct
  REGION 1..7: note = n-mer motif
RQGSLMI

SEQ ID NO: 7585 - protein, 7 aa, synthetic construct
  REGION 1..7: note = n-mer motif
ISTAYML

SEQ ID NO: 7586 - protein, 7 aa, synthetic construct
  REGION 1..7: note = n-mer motif
GTMNIGI

SEQ ID NO: 7587 - protein, 7 aa, synthetic construct
  REGION 1..7: note = n-mer motif
HNNNLLN

SEQ ID NO: 7588 - protein, 7 aa, synthetic construct
  REGION 1..7: note = n-mer motif
HFSQITN

SEQ ID NO: 7589 - protein, 7 aa, synthetic construct
  REGION 1..7: note = n-mer motif
DLTRAAI

SEQ ID NO: 7590 - protein, 7 aa, synthetic construct
  REGION 1..7: note = n-mer motif
VAMGGGP

SEQ ID NO: 7591 - protein, 7 aa, synthetic construct
  REGION 1..7: note = n-mer motif
AYGIREV

SEQ ID NO: 7592 - protein, 7 aa, synthetic construct
  REGION 1..7: note = n-mer motif
TSDGLLS

SEQ ID NO: 7593 - protein, 7 aa, synthetic construct
  REGION 1..7: note = n-mer motif
TMATNLS

SEQ ID NO: 7594 - protein, 7 aa, synthetic construct
  REGION 1..7: note = n-mer motif
NNGNSSR

SEQ ID NO: 7595 - protein, 7 aa, synthetic construct
  REGION 1..7: note = n-mer motif
TEKASPL

SEQ ID NO: 7596 - protein, 7 aa, synthetic construct
  REGION 1..7: note = n-mer motif
LNHTMPL

SEQ ID NO: 7597 - protein, 7 aa, synthetic construct
  REGION 1..7: note = n-mer motif
DTASYNN

SEQ ID NO: 7598 - protein, 7 aa, synthetic construct
  REGION 1..7: note = n-mer motif
NMTNERL

SEQ ID NO: 7599 - protein, 7 aa, synthetic construct
  REGION 1..7: note = n-mer motif
VVSSGGW

SEQ ID NO: 7600 - protein, 7 aa, synthetic construct
  REGION 1..7: note = n-mer motif
VNQSPGA

SEQ ID NO: 7601 - protein, 7 aa, synthetic construct
  REGION 1..7: note = n-mer motif
DHHPQSR

SEQ ID NO: 7602 - protein, 7 aa, synthetic construct
  REGION 1..7: note = n-mer motif
RWQGLSA

SEQ ID NO: 7603 - protein, 7 aa, synthetic construct
  REGION 1..7: note = n-mer motif
AVTTSVR

SEQ ID NO: 7604 - protein, 7 aa, synthetic construct
  REGION 1..7: note = n-mer motif
WGVSNSA

SEQ ID NO: 7605 - protein, 7 aa, synthetic construct
  REGION 1..7: note = n-mer motif
AHMHSEL

SEQ ID NO: 7606 - protein, 7 aa, synthetic construct
  REGION 1..7: note = n-mer motif
NNLTNST

SEQ ID NO: 7607 - protein, 7 aa, synthetic construct
  REGION 1..7: note = n-mer motif
SSGGMKA

SEQ ID NO: 7608 - protein, 7 aa, synthetic construct
  REGION 1..7: note = n-mer motif
VGYGEHV

SEQ ID NO: 7609 - protein, 7 aa, synthetic construct
  REGION 1..7: note = n-mer motif
TIVSTSY

SEQ ID NO: 7610 - protein, 7 aa, synthetic construct
  REGION 1..7: note = n-mer motif
PTSHQEP

SEQ ID NO: 7611 - protein, 7 aa, synthetic construct
  REGION 1..7: note = n-mer motif
SNLRNTI

SEQ ID NO: 7612 - protein, 7 aa, synthetic construct
  REGION 1..7: note = n-mer motif
SRHDVRN

SEQ ID NO: 7613 - protein, 7 aa, synthetic construct
  REGION 1..7: note = n-mer motif
QMNIHDK

SEQ ID NO: 7614 - protein, 7 aa, synthetic construct
  REGION 1..7: note = n-mer motif
WAMNNVP

SEQ ID NO: 7615 - protein, 7 aa, synthetic construct
  REGION 1..7: note = n-mer motif
AMDGYRV

SEQ ID NO: 7616 - protein, 7 aa, synthetic construct
  REGION 1..7: note = n-mer motif
KGGNLTA

SEQ ID NO: 7617 - protein, 7 aa, synthetic construct
  REGION 1..7: note = n-mer motif
IGKDSVP

SEQ ID NO: 7618 - protein, 7 aa, synthetic construct
  REGION 1..7: note = n-mer motif
VQLTHNG

SEQ ID NO: 7619 - protein, 7 aa, synthetic construct
  REGION 1..7: note = n-mer motif
GLNQITS

SEQ ID NO: 7620 - protein, 7 aa, synthetic construct
  REGION 1..7: note = n-mer motif
RGDPSTP

SEQ ID NO: 7621 - protein, 7 aa, synthetic construct
  REGION 1..7: note = n-mer motif
VPSDPHW

SEQ ID NO: 7622 - protein, 7 aa, synthetic construct
  REGION 1..7: note = n-mer motif
TLSSQVT

SEQ ID NO: 7623 - protein, 7 aa, synthetic construct
  REGION 1..7: note = n-mer motif
NQRVEQK

SEQ ID NO: 7624 - protein, 7 aa, synthetic construct
  REGION 1..7: note = n-mer motif
VLPSRIA

SEQ ID NO: 7625 - protein, 7 aa, synthetic construct
  REGION 1..7: note = n-mer motif
GHYATNT

SEQ ID NO: 7626 - protein, 7 aa, synthetic construct
  REGION 1..7: note = n-mer motif
PSIPSFS

SEQ ID NO: 7627 - protein, 7 aa, synthetic construct
  REGION 1..7: note = n-mer motif
TYEYPTR

SEQ ID NO: 7628 - protein, 7 aa, synthetic construct
  REGION 1..7: note = n-mer motif
KDHILSL

SEQ ID NO: 7629 - protein, 7 aa, synthetic construct
  REGION 1..7: note = n-mer motif
GTGGNRE

SEQ ID NO: 7630 - protein, 7 aa, synthetic construct
  REGION 1..7: note = n-mer motif
KGDGAYE

SEQ ID NO: 7631 - protein, 7 aa, synthetic construct
  REGION 1..7: note = n-mer motif
SSFGKDN

SEQ ID NO: 7632 - protein, 7 aa, synthetic construct
  REGION 1..7: note = n-mer motif
TVSSYVQ

SEQ ID NO: 7633 - protein, 7 aa, synthetic construct
  REGION 1..7: note = n-mer motif
RAHGDNQ

SEQ ID NO: 7634 - protein, 7 aa, synthetic construct
  REGION 1..7: note = n-mer motif
YHAHSNE

SEQ ID NO: 7635 - protein, 7 aa, synthetic construct
  REGION 1..7: note = n-mer motif
ANLPSGH

SEQ ID NO: 7636 - protein, 7 aa, synthetic construct
  REGION 1..7: note = n-mer motif
ANLNLTS

SEQ ID NO: 7637 - protein, 7 aa, synthetic construct
  REGION 1..7: note = n-mer motif
RLNAGEH

SEQ ID NO: 7638 - protein, 7 aa, synthetic construct
  REGION 1..7: note = n-mer motif
YVDYSKS

SEQ ID NO: 7639 - protein, 7 aa, synthetic construct
  REGION 1..7: note = n-mer motif
ANSGLHN

SEQ ID NO: 7640 - protein, 7 aa, synthetic construct
  REGION 1..7: note = n-mer motif
TSGVLTR

SEQ ID NO: 7641 - protein, 7 aa, synthetic construct
  REGION 1..7: note = n-mer motif
GKPAQEF

SEQ ID NO: 7642 - protein, 7 aa, synthetic construct
  REGION 1..7: note = n-mer motif
VGTHLHS

SEQ ID NO: 7643 - protein, 7 aa, synthetic construct
  REGION 1..7: note = n-mer motif
PMNKDIL

SEQ ID NO: 7644 - protein, 7 aa, synthetic construct
  REGION 1..7: note = n-mer motif
DAHHSSS

SEQ ID NO: 7645 - protein, 7 aa, synthetic construct
  REGION 1..7: note = n-mer motif
TNAISQT

SEQ ID NO: 7646 - protein, 7 aa, synthetic construct
  REGION 1..7: note = n-mer motif
VLSDKAY

SEQ ID NO: 7647 - protein, 7 aa, synthetic construct
  REGION 1..7: note = n-mer motif
NLLVDQR

SEQ ID NO: 7648 - protein, 7 aa, synthetic construct
  REGION 1..7: note = n-mer motif
TGHPPAA

SEQ ID NO: 7649 - protein, 7 aa, synthetic construct
  REGION 1..7: note = n-mer motif
ISSGILS

SEQ ID NO: 7650 - protein, 7 aa, synthetic construct
  REGION 1..7: note = n-mer motif
NTNLLGY

SEQ ID NO: 7651 - protein, 7 aa, synthetic construct
  REGION 1..7: note = n-mer motif
TLSVTLG

SEQ ID NO: 7652 - protein, 7 aa, synthetic construct
  REGION 1..7: note = n-mer motif
HTGVQTN

SEQ ID NO: 7653 - protein, 7 aa, synthetic construct
  REGION 1..7: note = n-mer motif
EVSNNNY

SEQ ID NO: 7654 - protein, 7 aa, synthetic construct
  REGION 1..7: note = n-mer motif
LANISLY

SEQ ID NO: 7655 - protein, 7 aa, synthetic construct
  REGION 1..7: note = n-mer motif
VEHVAHQ

SEQ ID NO: 7656 - protein, 7 aa, synthetic construct
  REGION 1..7: note = n-mer motif
VDKSEAD

SEQ ID NO: 7657 - protein, 7 aa, synthetic construct
  REGION 1..7: note = n-mer motif
GFALTGT

SEQ ID NO: 7658 - protein, 7 aa, synthetic construct
  REGION 1..7: note = n-mer motif
LLTAPHR

SEQ ID NO: 7659 - protein, 7 aa, synthetic construct
  REGION 1..7: note = n-mer motif
NAGALMG

SEQ ID NO: 7660 - protein, 7 aa, synthetic construct
  REGION 1..7: note = n-mer motif
RTQAGDS

SEQ ID NO: 7661 - protein, 7 aa, synthetic construct
  REGION 1..7: note = n-mer motif
NTHRQEY

SEQ ID NO: 7662 - protein, 7 aa, synthetic construct
  REGION 1..7: note = n-mer motif
NIAGGEQ

SEQ ID NO: 7663 - protein, 7 aa, synthetic construct
  REGION 1..7: note = n-mer motif
EINNRTG

SEQ ID NO: 7664 - protein, 7 aa, synthetic construct
  REGION 1..7: note = n-mer motif
TVNTMYT

SEQ ID NO: 7665 - protein, 7 aa, synthetic construct
  REGION 1..7: note = n-mer motif
PMNGILL

SEQ ID NO: 7666 - protein, 7 aa, synthetic construct
  REGION 1..7: note = n-mer motif
NPSYDHR

SEQ ID NO: 7667 - protein, 7 aa, synthetic construct
  REGION 1..7: note = n-mer motif
AVILNPV

SEQ ID NO: 7668 - protein, 7 aa, synthetic construct
  REGION 1..7: note = n-mer motif
LYGGAHQ

SEQ ID NO: 7669 - protein, 7 aa, synthetic construct
  REGION 1..7: note = n-mer motif
QVNQPRI

SEQ ID NO: 7670 - protein, 7 aa, synthetic construct
  REGION 1..7: note = n-mer motif
AVRTPAM

SEQ ID NO: 7671 - protein, 7 aa, synthetic construct
  REGION 1..7: note = n-mer motif
SLTPNNL

SEQ ID NO: 7672 - protein, 7 aa, synthetic construct
  REGION 1..7: note = n-mer motif
LGQVNST

SEQ ID NO: 7673 - protein, 7 aa, synthetic construct
  REGION 1..7: note = n-mer motif
ANSATNQ

SEQ ID NO: 7674 - protein, 7 aa, synthetic construct
  REGION 1..7: note = n-mer motif
SLTEKAP

SEQ ID NO: 7675 - protein, 7 aa, synthetic construct
  REGION 1..7: note = n-mer motif
QFHGTSE

SEQ ID NO: 7676 - protein, 7 aa, synthetic construct
  REGION 1..7: note = n-mer motif
KNGAIGT

SEQ ID NO: 7677 - protein, 7 aa, synthetic construct
  REGION 1..7: note = n-mer motif
VLASTEK

SEQ ID NO: 7678 - protein, 7 aa, synthetic construct
  REGION 1..7: note = n-mer motif
SNMSEAI

SEQ ID NO: 7679 - protein, 7 aa, synthetic construct
  REGION 1..7: note = n-mer motif
NANAGGN

SEQ ID NO: 7680 - protein, 7 aa, synthetic construct
  REGION 1..7: note = n-mer motif
HSNTHYE

SEQ ID NO: 7681 - protein, 7 aa, synthetic construct
  REGION 1..7: note = n-mer motif
SALISVV

SEQ ID NO: 7682 - protein, 7 aa, synthetic construct
  REGION 1..7: note = n-mer motif
VATHYNE

SEQ ID NO: 7683 - protein, 7 aa, synthetic construct
  REGION 1..7: note = n-mer motif
NQTLQVD

SEQ ID NO: 7684 - protein, 7 aa, synthetic construct
  REGION 1..7: note = n-mer motif
KTPSASE

SEQ ID NO: 7685 - protein, 7 aa, synthetic construct
  REGION 1..7: note = n-mer motif
GESRTNM

SEQ ID NO: 7686 - protein, 7 aa, synthetic construct
  REGION 1..7: note = n-mer motif
RNEPVST

SEQ ID NO: 7687 - protein, 7 aa, synthetic construct
  REGION 1..7: note = n-mer motif
ATHAMRP

SEQ ID NO: 7688 - protein, 7 aa, synthetic construct
  REGION 1..7: note = n-mer motif
WESLSNA

SEQ ID NO: 7689 - protein, 7 aa, synthetic construct
  REGION 1..7: note = n-mer motif
HSPPTTM

SEQ ID NO: 7690 - protein, 7 aa, synthetic construct
  REGION 1..7: note = n-mer motif
STMNTIT

SEQ ID NO: 7691 - protein, 7 aa, synthetic construct
  REGION 1..7: note = n-mer motif
NMEHTMA

SEQ ID NO: 7692 - protein, 7 aa, synthetic construct
  REGION 1..7: note = n-mer motif
HNTESKT

SEQ ID NO: 7693 - protein, 7 aa, synthetic construct
  REGION 1..7: note = n-mer motif
HNLMTQI

SEQ ID NO: 7694 - protein, 7 aa, synthetic construct
  REGION 1..7: note = n-mer motif
NQNTYEL

SEQ ID NO: 7695 - protein, 7 aa, synthetic construct
  REGION 1..7: note = n-mer motif
YATLDTI

SEQ ID NO: 7696 - protein, 7 aa, synthetic construct
  REGION 1..7: note = n-mer motif
VQLENAN

SEQ ID NO: 7697 - protein, 7 aa, synthetic construct
  REGION 1..7: note = n-mer motif
GLTGYTM

SEQ ID NO: 7698 - protein, 7 aa, synthetic construct
  REGION 1..7: note = n-mer motif
LVLDSRN

SEQ ID NO: 7699 - protein, 7 aa, synthetic construct
  REGION 1..7: note = n-mer motif
MLVQNTP

SEQ ID NO: 7700 - protein, 7 aa, synthetic construct
  REGION 1..7: note = n-mer motif
PHNQEMG

SEQ ID NO: 7701 - protein, 7 aa, synthetic construct
  REGION 1..7: note = n-mer motif
SLGDAML

SEQ ID NO: 7702 - protein, 7 aa, synthetic construct
  REGION 1..7: note = n-mer motif
RAEGSSG

SEQ ID NO: 7703 - protein, 7 aa, synthetic construct
  REGION 1..7: note = n-mer motif
SEERTRA

SEQ ID NO: 7704 - protein, 7 aa, synthetic construct
  REGION 1..7: note = n-mer motif
SSKERTS

SEQ ID NO: 7705 - protein, 7 aa, synthetic construct
  REGION 1..7: note = n-mer motif
PVVRDRS

SEQ ID NO: 7706 - protein, 7 aa, synthetic construct
  REGION 1..7: note = n-mer motif
RMSESSD

SEQ ID NO: 7707 - protein, 7 aa, synthetic construct
  REGION 1..7: note = n-mer motif
NQSISMD

SEQ ID NO: 7708 - protein, 7 aa, synthetic construct
  REGION 1..7: note = n-mer motif
VAVSNTP

SEQ ID NO: 7709 - protein, 7 aa, synthetic construct
  REGION 1..7: note = n-mer motif
GDISSRN

SEQ ID NO: 7710 - protein, 7 aa, synthetic construct
  REGION 1..7: note = n-mer motif
AAGADSP

SEQ ID NO: 7711 - protein, 7 aa, synthetic construct
  REGION 1..7: note = n-mer motif
FGTSYTT

SEQ ID NO: 7712 - protein, 7 aa, synthetic construct
  REGION 1..7: note = n-mer motif
RDTNTDK

SEQ ID NO: 7713 - protein, 7 aa, synthetic construct
  REGION 1..7: note = n-mer motif
GSTPGAS

SEQ ID NO: 7714 - protein, 7 aa, synthetic construct
  REGION 1..7: note = n-mer motif
GTNHDFS

SEQ ID NO: 7715 - protein, 7 aa, synthetic construct
  REGION 1..7: note = n-mer motif
NESTKES

SEQ ID NO: 7716 - protein, 7 aa, synthetic construct
  REGION 1..7: note = n-mer motif
VHVTNVL

SEQ ID NO: 7717 - protein, 7 aa, synthetic construct
  REGION 1..7: note = n-mer motif
STTNVAY

SEQ ID NO: 7718 - protein, 7 aa, synthetic construct
  REGION 1..7: note = n-mer motif
ITSLNGM

SEQ ID NO: 7719 - protein, 7 aa, synthetic construct
  REGION 1..7: note = n-mer motif
EVRGSVP

SEQ ID NO: 7720 - protein, 7 aa, synthetic construct
  REGION 1..7: note = n-mer motif
ALTRMPN

SEQ ID NO: 7721 - protein, 7 aa, synthetic construct
  REGION 1..7: note = n-mer motif
LSVADRP

SEQ ID NO: 7722 - protein, 7 aa, synthetic construct
  REGION 1..7: note = n-mer motif
VSTAQRQ

SEQ ID NO: 7723 - protein, 7 aa, synthetic construct
  REGION 1..7: note = n-mer motif
LNAEYTN

SEQ ID NO: 7724 - protein, 7 aa, synthetic construct
  REGION 1..7: note = n-mer motif
NEKPQST

SEQ ID NO: 7725 - protein, 7 aa, synthetic construct
  REGION 1..7: note = n-mer motif
LNTLIDK

SEQ ID NO: 7726 - protein, 7 aa, synthetic construct
  REGION 1..7: note = n-mer motif
VTHTLIE

SEQ ID NO: 7727 - protein, 7 aa, synthetic construct
  REGION 1..7: note = n-mer motif
EQKKTDH

SEQ ID NO: 7728 - protein, 7 aa, synthetic construct
  REGION 1..7: note = n-mer motif
TSGMYDT

SEQ ID NO: 7729 - protein, 7 aa, synthetic construct
  REGION 1..7: note = n-mer motif
PDAARSP

SEQ ID NO: 7730 - protein, 7 aa, synthetic construct
  REGION 1..7: note = n-mer motif
LTQVYHE

SEQ ID NO: 7731 - protein, 7 aa, synthetic construct
  REGION 1..7: note = n-mer motif
REMSSLS

SEQ ID NO: 7732 - protein, 7 aa, synthetic construct
  REGION 1..7: note = n-mer motif
MPSKGEV

SEQ ID NO: 7733 - protein, 7 aa, synthetic construct
  REGION 1..7: note = n-mer motif
NEQNTPS

SEQ ID NO: 7734 - protein, 7 aa, synthetic construct
  REGION 1..7: note = n-mer motif
KNYASTD

SEQ ID NO: 7735 - protein, 7 aa, synthetic construct
  REGION 1..7: note = n-mer motif
CMDVGKA

SEQ ID NO: 7736 - protein, 7 aa, synthetic construct
  REGION 1..7: note = n-mer motif
ALHNLMN

SEQ ID NO: 7737 - protein, 7 aa, synthetic construct
  REGION 1..7: note = n-mer motif
PDRANDK

SEQ ID NO: 7738 - protein, 7 aa, synthetic construct
  REGION 1..7: note = n-mer motif
IAHVSTN

SEQ ID NO: 7739 - protein, 7 aa, synthetic construct
  REGION 1..7: note = n-mer motif
NGPTGSA

SEQ ID NO: 7740 - protein, 7 aa, synthetic construct
  REGION 1..7: note = n-mer motif
STHHADR

SEQ ID NO: 7741 - protein, 7 aa, synthetic construct
  REGION 1..7: note = n-mer motif
GSQYGRH

SEQ ID NO: 7742 - protein, 7 aa, synthetic construct
  REGION 1..7: note = n-mer motif
TGTATLP

SEQ ID NO: 7743 - protein, 7 aa, synthetic construct
  REGION 1..7: note = n-mer motif
KAHVVEI

SEQ ID NO: 7744 - protein, 7 aa, synthetic construct
  REGION 1..7: note = n-mer motif
TSQGRSP

SEQ ID NO: 7745 - protein, 7 aa, synthetic construct
  REGION 1..7: note = n-mer motif
LSSESPR

SEQ ID NO: 7746 - protein, 7 aa, synthetic construct
  REGION 1..7: note = n-mer motif
TGVRETI

SEQ ID NO: 7747 - protein, 7 aa, synthetic construct
  REGION 1..7: note = n-mer motif
MDTELYR

SEQ ID NO: 7748 - protein, 7 aa, synthetic construct
  REGION 1..7: note = n-mer motif
TPEASAR

SEQ ID NO: 7749 - protein, 7 aa, synthetic construct
  REGION 1..7: note = n-mer motif
HDLNHGK

SEQ ID NO: 7750 - protein, 7 aa, synthetic construct
  REGION 1..7: note = n-mer motif
LTGQNAI

SEQ ID NO: 7751 - protein, 7 aa, synthetic construct
  REGION 1..7: note = n-mer motif
TVGSNSI

SEQ ID NO: 7752 - protein, 7 aa, synthetic construct
  REGION 1..7: note = n-mer motif
HTVGAMH

SEQ ID NO: 7753 - protein, 7 aa, synthetic construct
  REGION 1..7: note = n-mer motif
ERVNGMA

SEQ ID NO: 7754 - protein, 7 aa, synthetic construct
  REGION 1..7: note = n-mer motif
SEPLRVG

SEQ ID NO: 7755 - protein, 7 aa, synthetic construct
  REGION 1..7: note = n-mer motif
VSNVLYS

SEQ ID NO: 7756 - protein, 7 aa, synthetic construct
  REGION 1..7: note = n-mer motif
FSSGTTI

SEQ ID NO: 7757 - protein, 7 aa, synthetic construct
  REGION 1..7: note = n-mer motif
TNLSQSA

SEQ ID NO: 7758 - protein, 7 aa, synthetic construct
  REGION 1..7: note = n-mer motif
PNTASNF

SEQ ID NO: 7759 - protein, 7 aa, synthetic construct
  REGION 1..7: note = n-mer motif
CGLNCGK

SEQ ID NO: 7760 - protein, 7 aa, synthetic construct
  REGION 1..7: note = n-mer motif
PTGGSPP

SEQ ID NO: 7761 - protein, 7 aa, synthetic construct
  REGION 1..7: note = n-mer motif
YLESNYT

SEQ ID NO: 7762 - protein, 7 aa, synthetic construct
  REGION 1..7: note = n-mer motif
TLETTRS

SEQ ID NO: 7763 - protein, 7 aa, synthetic construct
  REGION 1..7: note = n-mer motif
SANEHNH

SEQ ID NO: 7764 - protein, 7 aa, synthetic construct
  REGION 1..7: note = n-mer motif
ARVDTNQ

SEQ ID NO: 7765 - protein, 7 aa, synthetic construct
  REGION 1..7: note = n-mer motif
NVVKNNT

SEQ ID NO: 7766 - protein, 7 aa, synthetic construct
  REGION 1..7: note = n-mer motif
GSYSDGS

SEQ ID NO: 7767 - protein, 7 aa, synthetic construct
  REGION 1..7: note = n-mer motif
PGNGQSP

SEQ ID NO: 7768 - protein, 7 aa, synthetic construct
  REGION 1..7: note = n-mer motif
SGVNFGV

SEQ ID NO: 7769 - protein, 7 aa, synthetic construct
  REGION 1..7: note = n-mer motif
RINAAID

SEQ ID NO: 7770 - protein, 7 aa, synthetic construct
  REGION 1..7: note = n-mer motif
QAGNAPR

SEQ ID NO: 7771 - protein, 7 aa, synthetic construct
  REGION 1..7: note = n-mer motif
QSGSLVP

SEQ ID NO: 7772 - protein, 7 aa, synthetic construct
  REGION 1..7: note = n-mer motif
FSTQDIS

SEQ ID NO: 7773 - protein, 7 aa, synthetic construct
  REGION 1..7: note = n-mer motif
VNPHPAQ

SEQ ID NO: 7774 - protein, 7 aa, synthetic construct
  REGION 1..7: note = n-mer motif
KGHAYEA

SEQ ID NO: 7775 - protein, 7 aa, synthetic construct
  REGION 1..7: note = n-mer motif
EDSMRFS

SEQ ID NO: 7776 - protein, 7 aa, synthetic construct
  REGION 1..7: note = n-mer motif
GRNESPE

SEQ ID NO: 7777 - protein, 7 aa, synthetic construct
  REGION 1..7: note = n-mer motif
SDGSKLL

SEQ ID NO: 7778 - protein, 7 aa, synthetic construct
  REGION 1..7: note = n-mer motif
TLSGYMR

SEQ ID NO: 7779 - protein, 7 aa, synthetic construct
  REGION 1..7: note = n-mer motif
DIHNPRT

SEQ ID NO: 7780 - protein, 7 aa, synthetic construct
  REGION 1..7: note = n-mer motif
WAKDVNV

SEQ ID NO: 7781 - protein, 7 aa, synthetic construct
  REGION 1..7: note = n-mer motif
AVGRSDD

SEQ ID NO: 7782 - protein, 7 aa, synthetic construct
  REGION 1..7: note = n-mer motif
KEKTTRE

SEQ ID NO: 7783 - protein, 7 aa, synthetic construct
  REGION 1..7: note = n-mer motif
LLQSTYL

SEQ ID NO: 7784 - protein, 7 aa, synthetic construct
  REGION 1..7: note = n-mer motif
KSNLEGK

SEQ ID NO: 7785 - protein, 7 aa, synthetic construct
  REGION 1..7: note = n-mer motif
TRTPFLG

SEQ ID NO: 7786 - protein, 7 aa, synthetic construct
  REGION 1..7: note = n-mer motif
QSDTTSI

SEQ ID NO: 7787 - protein, 7 aa, synthetic construct
  REGION 1..7: note = n-mer motif
AWSQVLT

SEQ ID NO: 7788 - protein, 7 aa, synthetic construct
  REGION 1..7: note = n-mer motif
TQERPLI

SEQ ID NO: 7789 - protein, 7 aa, synthetic construct
  REGION 1..7: note = n-mer motif
DDKTGRY

SEQ ID NO: 7790 - protein, 7 aa, synthetic construct
  REGION 1..7: note = n-mer motif
FPSHNGA

SEQ ID NO: 7791 - protein, 7 aa, synthetic construct
  REGION 1..7: note = n-mer motif
MLSQVLT

SEQ ID NO: 7792 - protein, 7 aa, synthetic construct
  REGION 1..7: note = n-mer motif
SVTTNLM

SEQ ID NO: 7793 - protein, 7 aa, synthetic construct
  REGION 1..7: note = n-mer motif
EHNSKTY

SEQ ID NO: 7794 - protein, 7 aa, synthetic construct
  REGION 1..7: note = n-mer motif
YAHPVTH

SEQ ID NO: 7795 - protein, 7 aa, synthetic construct
  REGION 1..7: note = n-mer motif
PNPSPRQ

SEQ ID NO: 7796 - protein, 7 aa, synthetic construct
  REGION 1..7: note = n-mer motif
HMGLNEL

SEQ ID NO: 7797 - protein, 7 aa, synthetic construct
  REGION 1..7: note = n-mer motif
NSLQASA

SEQ ID NO: 7798 - protein, 7 aa, synthetic construct
  REGION 1..7: note = n-mer motif
DLGTART

SEQ ID NO: 7799 - protein, 7 aa, synthetic construct
  REGION 1..7: note = n-mer motif
YDSRLYA

SEQ ID NO: 7800 - protein, 7 aa, synthetic construct
  REGION 1..7: note = n-mer motif
PKPGTGE

SEQ ID NO: 7801 - protein, 7 aa, synthetic construct
  REGION 1..7: note = n-mer motif
SLNGVLV

SEQ ID NO: 7802 - protein, 7 aa, synthetic construct
  REGION 1..7: note = n-mer motif
QSNLVIN

SEQ ID NO: 7803 - protein, 7 aa, synthetic construct
  REGION 1..7: note = n-mer motif
ASPAQTG

SEQ ID NO: 7804 - protein, 7 aa, synthetic construct
  REGION 1..7: note = n-mer motif
NMTNENG

SEQ ID NO: 7805 - protein, 7 aa, synthetic construct
  REGION 1..7: note = n-mer motif
SLRTDEF

SEQ ID NO: 7806 - protein, 7 aa, synthetic construct
  REGION 1..7: note = n-mer motif
ILDNHRF

SEQ ID NO: 7807 - protein, 7 aa, synthetic construct
  REGION 1..7: note = n-mer motif
LINMSQN

SEQ ID NO: 7808 - protein, 7 aa, synthetic construct
  REGION 1..7: note = n-mer motif
PQDVRQT

SEQ ID NO: 7809 - protein, 7 aa, synthetic construct
  REGION 1..7: note = n-mer motif
PFVANEP

SEQ ID NO: 7810 - protein, 7 aa, synthetic construct
  REGION 1..7: note = n-mer motif
NINDTKN

SEQ ID NO: 7811 - protein, 7 aa, synthetic construct
  REGION 1..7: note = n-mer motif
NFSSGDV

SEQ ID NO: 7812 - protein, 7 aa, synthetic construct
  REGION 1..7: note = n-mer motif
ERNGLIE

SEQ ID NO: 7813 - protein, 7 aa, synthetic construct
  REGION 1..7: note = n-mer motif
NSHVPNN

SEQ ID NO: 7814 - protein, 7 aa, synthetic construct
  REGION 1..7: note = n-mer motif
NTTGSSG

SEQ ID NO: 7815 - protein, 7 aa, synthetic construct
  REGION 1..7: note = n-mer motif
STRKEHD

SEQ ID NO: 7816 - protein, 7 aa, synthetic construct
  REGION 1..7: note = n-mer motif
AANPSTE

SEQ ID NO: 7817 - protein, 7 aa, synthetic construct
  REGION 1..7: note = n-mer motif
SGMNSNK

SEQ ID NO: 7818 - protein, 7 aa, synthetic construct
  REGION 1..7: note = n-mer motif
KTLDNNA

SEQ ID NO: 7819 - protein, 7 aa, synthetic construct
  REGION 1..7: note = n-mer motif
TVKQTSP

SEQ ID NO: 7820 - protein, 7 aa, synthetic construct
  REGION 1..7: note = n-mer motif
ISQVSFN

SEQ ID NO: 7821 - protein, 7 aa, synthetic construct
  REGION 1..7: note = n-mer motif
LEVNLQT

SEQ ID NO: 7822 - protein, 7 aa, synthetic construct
  REGION 1..7: note = n-mer motif
EMQTKNA

SEQ ID NO: 7823 - protein, 7 aa, synthetic construct
  REGION 1..7: note = n-mer motif
ADNRNDK

SEQ ID NO: 7824 - protein, 7 aa, synthetic construct
  REGION 1..7: note = n-mer motif
AYDTLNS

SEQ ID NO: 7825 - protein, 7 aa, synthetic construct
  REGION 1..7: note = n-mer motif
TIQDHIK

SEQ ID NO: 7826 - protein, 7 aa, synthetic construct
  REGION 1..7: note = n-mer motif
DPTKVGS

SEQ ID NO: 7827 - protein, 7 aa, synthetic construct
  REGION 1..7: note = n-mer motif
SLQRTPD

SEQ ID NO: 7828 - protein, 7 aa, synthetic construct
  REGION 1..7: note = n-mer motif
ANDSAKT

SEQ ID NO: 7829 - protein, 7 aa, synthetic construct
  REGION 1..7: note = n-mer motif
KKVEQEP

SEQ ID NO: 7830 - protein, 7 aa, synthetic construct
  REGION 1..7: note = n-mer motif
ASRDLGQ

SEQ ID NO: 7831 - protein, 7 aa, synthetic construct
  REGION 1..7: note = n-mer motif
WESDKFR

SEQ ID NO: 7832 - protein, 7 aa, synthetic construct
  REGION 1..7: note = n-mer motif
NRGTEVY

SEQ ID NO: 7833 - protein, 7 aa, synthetic construct
  REGION 1..7: note = n-mer motif
NISSINQ

SEQ ID NO: 7834 - protein, 7 aa, synthetic construct
  REGION 1..7: note = n-mer motif
ASKGFGH

SEQ ID NO: 7835 - protein, 7 aa, synthetic construct
  REGION 1..7: note = n-mer motif
QSQNVTQ

SEQ ID NO: 7836 - protein, 7 aa, synthetic construct
  REGION 1..7: note = n-mer motif
NGYQLQI

SEQ ID NO: 7837 - protein, 7 aa, synthetic construct
  REGION 1..7: note = n-mer motif
CTNASDL

SEQ ID NO: 7838 - protein, 7 aa, synthetic construct
  REGION 1..7: note = n-mer motif
TVASPNT

SEQ ID NO: 7839 - protein, 7 aa, synthetic construct
  REGION 1..7: note = n-mer motif
NTAPPNH

SEQ ID NO: 7840 - protein, 7 aa, synthetic construct
  REGION 1..7: note = n-mer motif
LSQQRDY

SEQ ID NO: 7841 - protein, 7 aa, synthetic construct
  REGION 1..7: note = n-mer motif
WNQNVSH

SEQ ID NO: 7842 - protein, 7 aa, synthetic construct
  REGION 1..7: note = n-mer motif
TGSSDRL

SEQ ID NO: 7843 - protein, 7 aa, synthetic construct
  REGION 1..7: note = n-mer motif
NTTPPNH

SEQ ID NO: 7844 - protein, 7 aa, synthetic construct
  REGION 1..7: note = n-mer motif
VVDSTYP

SEQ ID NO: 7845 - protein, 7 aa, synthetic construct
  REGION 1..7: note = n-mer motif
TDATGRH

SEQ ID NO: 7846 - protein, 7 aa, synthetic construct
  REGION 1..7: note = n-mer motif
LFTAGST

SEQ ID NO: 7847 - protein, 7 aa, synthetic construct
  REGION 1..7: note = n-mer motif
LRDQTSM

SEQ ID NO: 7848 - protein, 7 aa, synthetic construct
  REGION 1..7: note = n-mer motif
IETDRHR

SEQ ID NO: 7849 - protein, 7 aa, synthetic construct
  REGION 1..7: note = n-mer motif
SGPENTL

SEQ ID NO: 7850 - protein, 7 aa, synthetic construct
  REGION 1..7: note = n-mer motif
DNQNADR

SEQ ID NO: 7851 - protein, 7 aa, synthetic construct
  REGION 1..7: note = n-mer motif
HDGYVPN

SEQ ID NO: 7852 - protein, 7 aa, synthetic construct
  REGION 1..7: note = n-mer motif
HMSSYSS

SEQ ID NO: 7853 - protein, 7 aa, synthetic construct
  REGION 1..7: note = n-mer motif
SRLQTQQ

SEQ ID NO: 7854 - protein, 7 aa, synthetic construct
  REGION 1..7: note = n-mer motif
SYTAGRP

SEQ ID NO: 7855 - protein, 7 aa, synthetic construct
  REGION 1..7: note = n-mer motif
VQQNNIN

SEQ ID NO: 7856 - protein, 7 aa, synthetic construct
  REGION 1..7: note = n-mer motif
DAKALTT

SEQ ID NO: 7857 - protein, 7 aa, synthetic construct
  REGION 1..7: note = n-mer motif
KDEHLHY

SEQ ID NO: 7858 - protein, 7 aa, synthetic construct
  REGION 1..7: note = n-mer motif
HGDRTAL

SEQ ID NO: 7859 - protein, 7 aa, synthetic construct
  REGION 1..7: note = n-mer motif
NFTITEA

SEQ ID NO: 7860 - protein, 7 aa, synthetic construct
  REGION 1..7: note = n-mer motif
DTHMNKL

SEQ ID NO: 7861 - protein, 7 aa, synthetic construct
  REGION 1..7: note = n-mer motif
QPGAPQT

SEQ ID NO: 7862 - protein, 7 aa, synthetic construct
  REGION 1..7: note = n-mer motif
GEARREA

SEQ ID NO: 7863 - protein, 7 aa, synthetic construct
  REGION 1..7: note = n-mer motif
KSLSSDD

SEQ ID NO: 7864 - protein, 7 aa, synthetic construct
  REGION 1..7: note = n-mer motif
MNTTYNE

SEQ ID NO: 7865 - protein, 7 aa, synthetic construct
  REGION 1..7: note = n-mer motif
AAALETI

SEQ ID NO: 7866 - protein, 7 aa, synthetic construct
  REGION 1..7: note = n-mer motif
NVAPYSS

SEQ ID NO: 7867 - protein, 7 aa, synthetic construct
  REGION 1..7: note = n-mer motif
SAGMVSL

SEQ ID NO: 7868 - protein, 7 aa, synthetic construct
  REGION 1..7: note = n-mer motif
CDLSQSC

SEQ ID NO: 7869 - protein, 7 aa, synthetic construct
  REGION 1..7: note = n-mer motif
VLITMSS

SEQ ID NO: 7870 - protein, 7 aa, synthetic construct
  REGION 1..7: note = n-mer motif
QVGALMV

SEQ ID NO: 7871 - protein, 7 aa, synthetic construct
  REGION 1..7: note = n-mer motif
QRTSEAP

SEQ ID NO: 7872 - protein, 7 aa, synthetic construct
  REGION 1..7: note = n-mer motif
LGNGSSL

SEQ ID NO: 7873 - protein, 7 aa, synthetic construct
  REGION 1..7: note = n-mer motif
PSVRLPL

SEQ ID NO: 7874 - protein, 7 aa, synthetic construct
  REGION 1..7: note = n-mer motif
DSAPSTI

SEQ ID NO: 7875 - protein, 7 aa, synthetic construct
  REGION 1..7: note = n-mer motif
NYNGVNV

SEQ ID NO: 7876 - protein, 7 aa, synthetic construct
  REGION 1..7: note = n-mer motif
SAHQTPT

SEQ ID NO: 7877 - protein, 7 aa, synthetic construct
  REGION 1..7: note = n-mer motif
DHSKQIS

SEQ ID NO: 7878 - protein, 7 aa, synthetic construct
  REGION 1..7: note = n-mer motif
AASLSQS

SEQ ID NO: 7879 - protein, 7 aa, synthetic construct
  REGION 1..7: note = n-mer motif
HADVGMS

SEQ ID NO: 7880 - protein, 7 aa, synthetic construct
  REGION 1..7: note = n-mer motif
HVTVTLN

SEQ ID NO: 7881 - protein, 7 aa, synthetic construct
  REGION 1..7: note = n-mer motif
NSTHINS

SEQ ID NO: 7882 - protein, 7 aa, synthetic construct
  REGION 1..7: note = n-mer motif
LGLAGQV

SEQ ID NO: 7883 - protein, 7 aa, synthetic construct
  REGION 1..7: note = n-mer motif
SSQAHGP

SEQ ID NO: 7884 - protein, 7 aa, synthetic construct
  REGION 1..7: note = n-mer motif
AFKSGSI

SEQ ID NO: 7885 - protein, 7 aa, synthetic construct
  REGION 1..7: note = n-mer motif
HSPSHDS

SEQ ID NO: 7886 - protein, 7 aa, synthetic construct
  REGION 1..7: note = n-mer motif
PNGESSR

SEQ ID NO: 7887 - protein, 7 aa, synthetic construct
  REGION 1..7: note = n-mer motif
ILTPLDK

SEQ ID NO: 7888 - protein, 7 aa, synthetic construct
  REGION 1..7: note = n-mer motif
SASYSRM

SEQ ID NO: 7889 - protein, 7 aa, synthetic construct
  REGION 1..7: note = n-mer motif
EALHDRN

SEQ ID NO: 7890 - protein, 7 aa, synthetic construct
  REGION 1..7: note = n-mer motif
GEQHNAP

SEQ ID NO: 7891 - protein, 7 aa, synthetic construct
  REGION 1..7: note = n-mer motif
GNMVTPN

SEQ ID NO: 7892 - protein, 7 aa, synthetic construct
  REGION 1..7: note = n-mer motif
NALLNAP

SEQ ID NO: 7893 - protein, 7 aa, synthetic construct
  REGION 1..7: note = n-mer motif
ASDLQMT

SEQ ID NO: 7894 - protein, 7 aa, synthetic construct
  REGION 1..7: note = n-mer motif
SYDMHTN

SEQ ID NO: 7895 - protein, 7 aa, synthetic construct
  REGION 1..7: note = n-mer motif
NMSHSTL

SEQ ID NO: 7896 - protein, 7 aa, synthetic construct
  REGION 1..7: note = n-mer motif
TANNHSP

SEQ ID NO: 7897 - protein, 7 aa, synthetic construct
  REGION 1..7: note = n-mer motif
QAPPTAQ

SEQ ID NO: 7898 - protein, 7 aa, synthetic construct
  REGION 1..7: note = n-mer motif
NYHGDNV

SEQ ID NO: 7899 - protein, 7 aa, synthetic construct
  REGION 1..7: note = n-mer motif
RDSTISR

SEQ ID NO: 7900 - protein, 7 aa, synthetic construct
  REGION 1..7: note = n-mer motif
VSSPNGT

SEQ ID NO: 7901 - protein, 7 aa, synthetic construct
  REGION 1..7: note = n-mer motif
SRITVNA

SEQ ID NO: 7902 - protein, 7 aa, synthetic construct
  REGION 1..7: note = n-mer motif
VGTTSNG

SEQ ID NO: 7903 - protein, 7 aa, synthetic construct
  REGION 1..7: note = n-mer motif
HTNQMQP

SEQ ID NO: 7904 - protein, 7 aa, synthetic construct
  REGION 1..7: note = n-mer motif
KSNAGFG

SEQ ID NO: 7905 - protein, 7 aa, synthetic construct
  REGION 1..7: note = n-mer motif
KESLEDV

SEQ ID NO: 7906 - protein, 7 aa, synthetic construct
  REGION 1..7: note = n-mer motif
AQVNNHD

SEQ ID NO: 7907 - protein, 7 aa, synthetic construct
  REGION 1..7: note = n-mer motif
NASTYMD

SEQ ID NO: 7908 - protein, 7 aa, synthetic construct
  REGION 1..7: note = n-mer motif
TSDTNAR

SEQ ID NO: 7909 - protein, 7 aa, synthetic construct
  REGION 1..7: note = n-mer motif
ESRMRSI

SEQ ID NO: 7910 - protein, 7 aa, synthetic construct
  REGION 1..7: note = n-mer motif
RVEDTNS

SEQ ID NO: 7911 - protein, 7 aa, synthetic construct
  REGION 1..7: note = n-mer motif
ASNHLQA

SEQ ID NO: 7912 - protein, 7 aa, synthetic construct
  REGION 1..7: note = n-mer motif
RLHGSDS

SEQ ID NO: 7913 - protein, 7 aa, synthetic construct
  REGION 1..7: note = n-mer motif
TVEQINS

SEQ ID NO: 7914 - protein, 7 aa, synthetic construct
  REGION 1..7: note = n-mer motif
RSVPSPH

SEQ ID NO: 7915 - protein, 7 aa, synthetic construct
  REGION 1..7: note = n-mer motif
EYLALGH

SEQ ID NO: 7916 - protein, 7 aa, synthetic construct
  REGION 1..7: note = n-mer motif
NTNNQEQ

SEQ ID NO: 7917 - protein, 7 aa, synthetic construct
  REGION 1..7: note = n-mer motif
NYGSGRI

SEQ ID NO: 7918 - protein, 7 aa, synthetic construct
  REGION 1..7: note = n-mer motif
RHGDTPM

SEQ ID NO: 7919 - protein, 7 aa, synthetic construct
  REGION 1..7: note = n-mer motif
NDTIGRP

SEQ ID NO: 7920 - protein, 7 aa, synthetic construct
  REGION 1..7: note = n-mer motif
YGERART

SEQ ID NO: 7921 - protein, 7 aa, synthetic construct
  REGION 1..7: note = n-mer motif
VLGMQRS

SEQ ID NO: 7922 - protein, 7 aa, synthetic construct
  REGION 1..7: note = n-mer motif
LHFHASQ

SEQ ID NO: 7923 - protein, 7 aa, synthetic construct
  REGION 1..7: note = n-mer motif
TDTLSER

SEQ ID NO: 7924 - protein, 7 aa, synthetic construct
  REGION 1..7: note = n-mer motif
GTGTVGW

SEQ ID NO: 7925 - protein, 7 aa, synthetic construct
  REGION 1..7: note = n-mer motif
TESPKLL

SEQ ID NO: 7926 - protein, 7 aa, synthetic construct
  REGION 1..7: note = n-mer motif
TIRSEGF

SEQ ID NO: 7927 - protein, 7 aa, synthetic construct
  REGION 1..7: note = n-mer motif
ASSYINN

SEQ ID NO: 7928 - protein, 7 aa, synthetic construct
  REGION 1..7: note = n-mer motif
LHLGLSS

SEQ ID NO: 7929 - protein, 7 aa, synthetic construct
  REGION 1..7: note = n-mer motif
VTGTTPG

SEQ ID NO: 7930 - protein, 7 aa, synthetic construct
  REGION 1..7: note = n-mer motif
VTSSASG

SEQ ID NO: 7931 - protein, 7 aa, synthetic construct
  REGION 1..7: note = n-mer motif
QMHLHMQ

SEQ ID NO: 7932 - protein, 7 aa, synthetic construct
  REGION 1..7: note = n-mer motif
GTMSLLM

SEQ ID NO: 7933 - protein, 7 aa, synthetic construct
  REGION 1..7: note = n-mer motif
CASEVCQ

SEQ ID NO: 7934 - protein, 7 aa, synthetic construct
  REGION 1..7: note = n-mer motif
NLVMSGT

SEQ ID NO: 7935 - protein, 7 aa, synthetic construct
  REGION 1..7: note = n-mer motif
QSLKDGT

SEQ ID NO: 7936 - protein, 7 aa, synthetic construct
  REGION 1..7: note = n-mer motif
ALNGSGI

SEQ ID NO: 7937 - protein, 7 aa, synthetic construct
  REGION 1..7: note = n-mer motif
RHVVPDS

SEQ ID NO: 7938 - protein, 7 aa, synthetic construct
  REGION 1..7: note = n-mer motif
LYHDSHL

SEQ ID NO: 7939 - protein, 7 aa, synthetic construct
  REGION 1..7: note = n-mer motif
GSTPITS

SEQ ID NO: 7940 - protein, 7 aa, synthetic construct
  REGION 1..7: note = n-mer motif
PNDQISG

SEQ ID NO: 7941 - protein, 7 aa, synthetic construct
  REGION 1..7: note = n-mer motif
SGKQDKY

SEQ ID NO: 7942 - protein, 7 aa, synthetic construct
  REGION 1..7: note = n-mer motif
SGHASQG

SEQ ID NO: 7943 - protein, 7 aa, synthetic construct
  REGION 1..7: note = n-mer motif
KMGSIEV

SEQ ID NO: 7944 - protein, 7 aa, synthetic construct
  REGION 1..7: note = n-mer motif
STLDRSE

SEQ ID NO: 7945 - protein, 7 aa, synthetic construct
  REGION 1..7: note = n-mer motif
TELSEYT

SEQ ID NO: 7946 - protein, 7 aa, synthetic construct
  REGION 1..7: note = n-mer motif
ANGGGYP

SEQ ID NO: 7947 - protein, 7 aa, synthetic construct
  REGION 1..7: note = n-mer motif
VTESNSL

SEQ ID NO: 7948 - protein, 7 aa, synthetic construct
  REGION 1..7: note = n-mer motif
PVYDRDV

SEQ ID NO: 7949 - protein, 7 aa, synthetic construct
  REGION 1..7: note = n-mer motif
DNNKHGT

SEQ ID NO: 7950 - protein, 7 aa, synthetic construct
  REGION 1..7: note = n-mer motif
IYETVTL

SEQ ID NO: 7951 - protein, 7 aa, synthetic construct
  REGION 1..7: note = n-mer motif
TQTGHVS

SEQ ID NO: 7952 - protein, 7 aa, synthetic construct
  REGION 1..7: note = n-mer motif
QADLRYK

SEQ ID NO: 7953 - protein, 7 aa, synthetic construct
  REGION 1..7: note = n-mer motif
CKTNNAG

SEQ ID NO: 7954 - protein, 7 aa, synthetic construct
  REGION 1..7: note = n-mer motif
AGHQQLA

SEQ ID NO: 7955 - protein, 7 aa, synthetic construct
  REGION 1..7: note = n-mer motif
DRDMEGV

SEQ ID NO: 7956 - protein, 7 aa, synthetic construct
  REGION 1..7: note = n-mer motif
DQPGYVR

SEQ ID NO: 7957 - protein, 7 aa, synthetic construct
  REGION 1..7: note = n-mer motif
DAMLAHP

SEQ ID NO: 7958 - protein, 7 aa, synthetic construct
  REGION 1..7: note = n-mer motif
ALNLYSS

SEQ ID NO: 7959 - protein, 7 aa, synthetic construct
  REGION 1..7: note = n-mer motif
LLSKGDS

SEQ ID NO: 7960 - protein, 7 aa, synthetic construct
  REGION 1..7: note = n-mer motif
SSISLRY

SEQ ID NO: 7961 - protein, 7 aa, synthetic construct
  REGION 1..7: note = n-mer motif
GSSQHHE

SEQ ID NO: 7962 - protein, 7 aa, synthetic construct
  REGION 1..7: note = n-mer motif
SIGYSPP

SEQ ID NO: 7963 - protein, 7 aa, synthetic construct
  REGION 1..7: note = n-mer motif
HSNATTI

SEQ ID NO: 7964 - protein, 7 aa, synthetic construct
  REGION 1..7: note = n-mer motif
SAHDARL

SEQ ID NO: 7965 - protein, 7 aa, synthetic construct
  REGION 1..7: note = n-mer motif
VHTADTI

SEQ ID NO: 7966 - protein, 7 aa, synthetic construct
  REGION 1..7: note = n-mer motif
RDGSTKV

SEQ ID NO: 7967 - protein, 7 aa, synthetic construct
  REGION 1..7: note = n-mer motif
LQESLPG

SEQ ID NO: 7968 - protein, 7 aa, synthetic construct
  REGION 1..7: note = n-mer motif
LDYTPQN

SEQ ID NO: 7969 - protein, 7 aa, synthetic construct
  REGION 1..7: note = n-mer motif
GPSSHIV

SEQ ID NO: 7970 - protein, 7 aa, synthetic construct
  REGION 1..7: note = n-mer motif
SADTRSP

SEQ ID NO: 7971 - protein, 7 aa, synthetic construct
  REGION 1..7: note = n-mer motif
MMKSEEN

SEQ ID NO: 7972 - protein, 7 aa, synthetic construct
  REGION 1..7: note = n-mer motif
GMTSELT

SEQ ID NO: 7973 - protein, 7 aa, synthetic construct
  REGION 1..7: note = n-mer motif
VDTYSGL

SEQ ID NO: 7974 - protein, 7 aa, synthetic construct
  REGION 1..7: note = n-mer motif
GMRDTPP

SEQ ID NO: 7975 - protein, 7 aa, synthetic construct
  REGION 1..7: note = n-mer motif
EHDVSTR

SEQ ID NO: 7976 - protein, 7 aa, synthetic construct
  REGION 1..7: note = n-mer motif
EVVKTTH

SEQ ID NO: 7977 - protein, 7 aa, synthetic construct
  REGION 1..7: note = n-mer motif
VYDNVSS

SEQ ID NO: 7978 - protein, 7 aa, synthetic construct
  REGION 1..7: note = n-mer motif
LMKDMES

SEQ ID NO: 7979 - protein, 7 aa, synthetic construct
  REGION 1..7: note = n-mer motif
PLHVASP

SEQ ID NO: 7980 - protein, 7 aa, synthetic construct
  REGION 1..7: note = n-mer motif
EVRDQKT

SEQ ID NO: 7981 - protein, 7 aa, synthetic construct
  REGION 1..7: note = n-mer motif
PTPYYTA

SEQ ID NO: 7982 - protein, 7 aa, synthetic construct
  REGION 1..7: note = n-mer motif
NNYAYSA

SEQ ID NO: 7983 - protein, 7 aa, synthetic construct
  REGION 1..7: note = n-mer motif
LVDTDRN

SEQ ID NO: 7984 - protein, 7 aa, synthetic construct
  REGION 1..7: note = n-mer motif
YPADHRT

SEQ ID NO: 7985 - protein, 7 aa, synthetic construct
  REGION 1..7: note = n-mer motif
SATTNHG

SEQ ID NO: 7986 - protein, 7 aa, synthetic construct
  REGION 1..7: note = n-mer motif
RDDQQLD

SEQ ID NO: 7987 - protein, 7 aa, synthetic construct
  REGION 1..7: note = n-mer motif
GAGQSHV

SEQ ID NO: 7988 - protein, 7 aa, synthetic construct
  REGION 1..7: note = n-mer motif
DRTYHEV

SEQ ID NO: 7989 - protein, 7 aa, synthetic construct
  REGION 1..7: note = n-mer motif
DGNNTTY

SEQ ID NO: 7990 - protein, 7 aa, synthetic construct
  REGION 1..7: note = n-mer motif
VHMESYA

SEQ ID NO: 7991 - protein, 7 aa, synthetic construct
  REGION 1..7: note = n-mer motif
WYETISP

SEQ ID NO: 7992 - protein, 7 aa, synthetic construct
  REGION 1..7: note = n-mer motif
LLGAHQP

SEQ ID NO: 7993 - protein, 7 aa, synthetic construct
  REGION 1..7: note = n-mer motif
HVPNTEA

SEQ ID NO: 7994 - protein, 7 aa, synthetic construct
  REGION 1..7: note = n-mer motif
NSQNPQG

SEQ ID NO: 7995 - protein, 7 aa, synthetic construct
  REGION 1..7: note = n-mer motif
LQDRATN

SEQ ID NO: 7996 - protein, 7 aa, synthetic construct
  REGION 1..7: note = n-mer motif
IVNQHSE

SEQ ID NO: 7997 - protein, 7 aa, synthetic construct
  REGION 1..7: note = n-mer motif
FEQGKVE

SEQ ID NO: 7998 - protein, 7 aa, synthetic construct
  REGION 1..7: note = n-mer motif
VATGVFA

SEQ ID NO: 7999 - protein, 7 aa, synthetic construct
  REGION 1..7: note = n-mer motif
DKIQNET

SEQ ID NO: 8000 - protein, 7 aa, synthetic construct
  REGION 1..7: note = n-mer motif
TDNPSYK

SEQ ID NO: 8001 - protein, 7 aa, synthetic construct
  REGION 1..7: note = n-mer motif
GVNTKIE

SEQ ID NO: 8002 - protein, 7 aa, synthetic construct
  REGION 1..7: note = n-mer motif
GSHNGPA

SEQ ID NO: 8003 - protein, 7 aa, synthetic construct
  REGION 1..7: note = n-mer motif
SNMGVAS

SEQ ID NO: 8004 - protein, 7 aa, synthetic construct
  REGION 1..7: note = n-mer motif
NTDTNEK

SEQ ID NO: 8005 - protein, 7 aa, synthetic construct
  REGION 1..7: note = n-mer motif
SALLRMD

SEQ ID NO: 8006 - protein, 7 aa, synthetic construct
  REGION 1..7: note = n-mer motif
PQLSGTA

SEQ ID NO: 8007 - protein, 7 aa, synthetic construct
  REGION 1..7: note = n-mer motif
SIVNNGA

SEQ ID NO: 8008 - protein, 7 aa, synthetic construct
  REGION 1..7: note = n-mer motif
SLDHAPL

SEQ ID NO: 8009 - protein, 7 aa, synthetic construct
  REGION 1..7: note = n-mer motif
DHSKQNS

SEQ ID NO: 8010 - protein, 7 aa, synthetic construct
  REGION 1..7: note = n-mer motif
HSDMVSG

SEQ ID NO: 8011 - protein, 7 aa, synthetic construct
  REGION 1..7: note = n-mer motif
QHRAQDV

SEQ ID NO: 8012 - protein, 7 aa, synthetic construct
  REGION 1..7: note = n-mer motif
GSTKSGQ

SEQ ID NO: 8013 - protein, 7 aa, synthetic construct
  REGION 1..7: note = n-mer motif
TMSVTLE

SEQ ID NO: 8014 - protein, 7 aa, synthetic construct
  REGION 1..7: note = n-mer motif
YNNGGHV

SEQ ID NO: 8015 - protein, 7 aa, synthetic construct
  REGION 1..7: note = n-mer motif
GTAENTS

SEQ ID NO: 8016 - protein, 7 aa, synthetic construct
  REGION 1..7: note = n-mer motif
NSYDATR

SEQ ID NO: 8017 - protein, 7 aa, synthetic construct
  REGION 1..7: note = n-mer motif
SVNNMRL

SEQ ID NO: 8018 - protein, 7 aa, synthetic construct
  REGION 1..7: note = n-mer motif
LNLQYTL

SEQ ID NO: 8019 - protein, 7 aa, synthetic construct
  REGION 1..7: note = n-mer motif
EAQTGWV

SEQ ID NO: 8020 - protein, 7 aa, synthetic construct
  REGION 1..7: note = n-mer motif
PAEGNNR

SEQ ID NO: 8021 - protein, 7 aa, synthetic construct
  REGION 1..7: note = n-mer motif
SLGGNPP

SEQ ID NO: 8022 - protein, 7 aa, synthetic construct
  REGION 1..7: note = n-mer motif
YNRDNGS

SEQ ID NO: 8023 - protein, 7 aa, synthetic construct
  REGION 1..7: note = n-mer motif
LTDPKGQ

SEQ ID NO: 8024 - protein, 7 aa, synthetic construct
  REGION 1..7: note = n-mer motif
TPTGTNK

SEQ ID NO: 8025 - protein, 7 aa, synthetic construct
  REGION 1..7: note = n-mer motif
VHANATL

SEQ ID NO: 8026 - protein, 7 aa, synthetic construct
  REGION 1..7: note = n-mer motif
REIVHSN

SEQ ID NO: 8027 - protein, 7 aa, synthetic construct
  REGION 1..7: note = n-mer motif
YAVAIGT

SEQ ID NO: 8028 - protein, 7 aa, synthetic construct
  REGION 1..7: note = n-mer motif
NTTPPDH

SEQ ID NO: 8029 - protein, 7 aa, synthetic construct
  REGION 1..7: note = n-mer motif
VIQSDNT

SEQ ID NO: 8030 - protein, 7 aa, synthetic construct
  REGION 1..7: note = n-mer motif
VPAHSRG

SEQ ID NO: 8031 - protein, 7 aa, synthetic construct
  REGION 1..7: note = n-mer motif
QNSDLAS

SEQ ID NO: 8032 - protein, 7 aa, synthetic construct
  REGION 1..7: note = n-mer motif
RIVDTLG

SEQ ID NO: 8033 - protein, 7 aa, synthetic construct
  REGION 1..7: note = n-mer motif
HTYSQAD

SEQ ID NO: 8034 - protein, 7 aa, synthetic construct
  REGION 1..7: note = n-mer motif
TAPSVGS

SEQ ID NO: 8035 - protein, 7 aa, synthetic construct
  REGION 1..7: note = n-mer motif
NVGTDRD

SEQ ID NO: 8036 - protein, 7 aa, synthetic construct
  REGION 1..7: note = n-mer motif
GINRTSE

SEQ ID NO: 8037 - protein, 7 aa, synthetic construct
  REGION 1..7: note = n-mer motif
VETDSLI

SEQ ID NO: 8038 - protein, 7 aa, synthetic construct
  REGION 1..7: note = n-mer motif
HSAAGDG

SEQ ID NO: 8039 - protein, 7 aa, synthetic construct
  REGION 1..7: note = n-mer motif
DAGISSY

SEQ ID NO: 8040 - protein, 7 aa, synthetic construct
  REGION 1..7: note = n-mer motif
CTATKCS

SEQ ID NO: 8041 - protein, 7 aa, synthetic construct
  REGION 1..7: note = n-mer motif
RIDTLLV

SEQ ID NO: 8042 - protein, 7 aa, synthetic construct
  REGION 1..7: note = n-mer motif
VSQSHDV

SEQ ID NO: 8043 - protein, 7 aa, synthetic construct
  REGION 1..7: note = n-mer motif
ALPSHSS

SEQ ID NO: 8044 - protein, 7 aa, synthetic construct
  REGION 1..7: note = n-mer motif
GKPAEAP

SEQ ID NO: 8045 - protein, 7 aa, synthetic construct
  REGION 1..7: note = n-mer motif
WNSPGEA

SEQ ID NO: 8046 - protein, 7 aa, synthetic construct
  REGION 1..7: note = n-mer motif
RLERPDY

SEQ ID NO: 8047 - protein, 7 aa, synthetic construct
  REGION 1..7: note = n-mer motif
TRESLVD

SEQ ID NO: 8048 - protein, 7 aa, synthetic construct
  REGION 1..7: note = n-mer motif
RHEGPYS

SEQ ID NO: 8049 - protein, 7 aa, synthetic construct
  REGION 1..7: note = n-mer motif
VLSDKAF

SEQ ID NO: 8050 - protein, 7 aa, synthetic construct
  REGION 1..7: note = n-mer motif
TSATDSM

SEQ ID NO: 8051 - protein, 7 aa, synthetic construct
  REGION 1..7: note = n-mer motif
TEPLPMS

SEQ ID NO: 8052 - protein, 7 aa, synthetic construct
  REGION 1..7: note = n-mer motif
MPYVGTV

SEQ ID NO: 8053 - protein, 7 aa, synthetic construct
  REGION 1..7: note = n-mer motif
RDYSPTD

SEQ ID NO: 8054 - protein, 7 aa, synthetic construct
  REGION 1..7: note = n-mer motif
RNGGTTD

SEQ ID NO: 8055 - protein, 7 aa, synthetic construct
  REGION 1..7: note = n-mer motif
MMGATTK

SEQ ID NO: 8056 - protein, 7 aa, synthetic construct
  REGION 1..7: note = n-mer motif
AAVGGDT

SEQ ID NO: 8057 - protein, 7 aa, synthetic construct
  REGION 1..7: note = n-mer motif
LVNNDGT

SEQ ID NO: 8058 - protein, 7 aa, synthetic construct
  REGION 1..7: note = n-mer motif
SSTPQDT

SEQ ID NO: 8059 - protein, 7 aa, synthetic construct
  REGION 1..7: note = n-mer motif
SLRMENS

SEQ ID NO: 8060 - protein, 7 aa, synthetic construct
  REGION 1..7: note = n-mer motif
VQGQTGW

SEQ ID NO: 8061 - protein, 7 aa, synthetic construct
  REGION 1..7: note = n-mer motif
LGFTPQP

SEQ ID NO: 8062 - protein, 7 aa, synthetic construct
  REGION 1..7: note = n-mer motif
SVAKDQT

SEQ ID NO: 8063 - protein, 7 aa, synthetic construct
  REGION 1..7: note = n-mer motif
PRHELSN

SEQ ID NO: 8064 - protein, 7 aa, synthetic construct
  REGION 1..7: note = n-mer motif
KMGSNPA

SEQ ID NO: 8065 - protein, 7 aa, synthetic construct
  REGION 1..7: note = n-mer motif
EATHGSY

SEQ ID NO: 8066 - protein, 7 aa, synthetic construct
  REGION 1..7: note = n-mer motif
PEVACPG

SEQ ID NO: 8067 - protein, 7 aa, synthetic construct
  REGION 1..7: note = n-mer motif
VNTREVT

SEQ ID NO: 8068 - protein, 7 aa, synthetic construct
  REGION 1..7: note = n-mer motif
TARAIDM

SEQ ID NO: 8069 - protein, 7 aa, synthetic construct
  REGION 1..7: note = n-mer motif
TDGALGY

SEQ ID NO: 8070 - protein, 7 aa, synthetic construct
  REGION 1..7: note = n-mer motif
GSQYANR

SEQ ID NO: 8071 - protein, 7 aa, synthetic construct
  REGION 1..7: note = n-mer motif
EMGNQYP

SEQ ID NO: 8072 - protein, 7 aa, synthetic construct
  REGION 1..7: note = n-mer motif
PSTLAET

SEQ ID NO: 8073 - protein, 7 aa, synthetic construct
  REGION 1..7: note = n-mer motif
RIGVGAP

SEQ ID NO: 8074 - protein, 7 aa, synthetic construct
  REGION 1..7: note = n-mer motif
LSVKEEI

SEQ ID NO: 8075 - protein, 7 aa, synthetic construct
  REGION 1..7: note = n-mer motif
YTTHESG

SEQ ID NO: 8076 - protein, 7 aa, synthetic construct
  REGION 1..7: note = n-mer motif
LTAVLTV

SEQ ID NO: 8077 - protein, 7 aa, synthetic construct
  REGION 1..7: note = n-mer motif
LQTSVAT

SEQ ID NO: 8078 - protein, 7 aa, synthetic construct
  REGION 1..7: note = n-mer motif
TVRSPQP

SEQ ID NO: 8079 - protein, 7 aa, synthetic construct
  REGION 1..7: note = n-mer motif
HPDGTRP

SEQ ID NO: 8080 - protein, 7 aa, synthetic construct
  REGION 1..7: note = n-mer motif
GVTIGSR

SEQ ID NO: 8081 - protein, 7 aa, synthetic construct
  REGION 1..7: note = n-mer motif
TYASTEA

SEQ ID NO: 8082 - protein, 7 aa, synthetic construct
  REGION 1..7: note = n-mer motif
RSSPATN

SEQ ID NO: 8083 - protein, 7 aa, synthetic construct
  REGION 1..7: note = n-mer motif
IGSPLAN

SEQ ID NO: 8084 - protein, 7 aa, synthetic construct
  REGION 1..7: note = n-mer motif
ASTESHV

SEQ ID NO: 8085 - protein, 7 aa, synthetic construct
  REGION 1..7: note = n-mer motif
IAQNETY

SEQ ID NO: 8086 - protein, 7 aa, synthetic construct
  REGION 1..7: note = n-mer motif
MESKPWQ

SEQ ID NO: 8087 - protein, 7 aa, synthetic construct
  REGION 1..7: note = n-mer motif
LENPTPA

SEQ ID NO: 8088 - protein, 7 aa, synthetic construct
  REGION 1..7: note = n-mer motif
PNPSPRQ

SEQ ID NO: 8089 - protein, 7 aa, synthetic construct
  REGION 1..7: note = n-mer motif
STSNPPY

SEQ ID NO: 8090 - protein, 7 aa, synthetic construct
  REGION 1..7: note = n-mer motif
YLTDTPT

SEQ ID NO: 8091 - protein, 7 aa, synthetic construct
  REGION 1..7: note = n-mer motif
IRALMTD

SEQ ID NO: 8092 - protein, 7 aa, synthetic construct
  REGION 1..7: note = n-mer motif
PMGTDTV

SEQ ID NO: 8093 - protein, 7 aa, synthetic construct
  REGION 1..7: note = n-mer motif
TRTQGTS

SEQ ID NO: 8094 - protein, 7 aa, synthetic construct
  REGION 1..7: note = n-mer motif
SNNMNQA

SEQ ID NO: 8095 - protein, 7 aa, synthetic construct
  REGION 1..7: note = n-mer motif
EDSVNHI

SEQ ID NO: 8096 - protein, 7 aa, synthetic construct
  REGION 1..7: note = n-mer motif
SVVPTDK

SEQ ID NO: 8097 - protein, 7 aa, synthetic construct
  REGION 1..7: note = n-mer motif
VRGVQDA

SEQ ID NO: 8098 - protein, 7 aa, synthetic construct
  REGION 1..7: note = n-mer motif
HDVTVRN

SEQ ID NO: 8099 - protein, 7 aa, synthetic construct
  REGION 1..7: note = n-mer motif
HNNHAGE

SEQ ID NO: 8100 - protein, 7 aa, synthetic construct
  REGION 1..7: note = n-mer motif
GNMNHSI

SEQ ID NO: 8101 - protein, 7 aa, synthetic construct
  REGION 1..7: note = n-mer motif
GVHTHTV

SEQ ID NO: 8102 - protein, 7 aa, synthetic construct
  REGION 1..7: note = n-mer motif
FLPQLGQ

SEQ ID NO: 8103 - protein, 7 aa, synthetic construct
  REGION 1..7: note = n-mer motif
LANMSAP

SEQ ID NO: 8104 - protein, 7 aa, synthetic construct
  REGION 1..7: note = n-mer motif
VRRDETP

SEQ ID NO: 8105 - protein, 7 aa, synthetic construct
  REGION 1..7: note = n-mer motif
CRDNVLA

SEQ ID NO: 8106 - protein, 7 aa, synthetic construct
  REGION 1..7: note = n-mer motif
MLASRVP

SEQ ID NO: 8107 - protein, 7 aa, synthetic construct
  REGION 1..7: note = n-mer motif
VRTVLQQ

SEQ ID NO: 8108 - protein, 7 aa, synthetic construct
  REGION 1..7: note = n-mer motif
SNQNVDW

SEQ ID NO: 8109 - protein, 7 aa, synthetic construct
  REGION 1..7: note = n-mer motif
TEVTGDS

SEQ ID NO: 8110 - protein, 7 aa, synthetic construct
  REGION 1..7: note = n-mer motif
ESATSLK

SEQ ID NO: 8111 - protein, 7 aa, synthetic construct
  REGION 1..7: note = n-mer motif
NHPAPSS

SEQ ID NO: 8112 - protein, 7 aa, synthetic construct
  REGION 1..7: note = n-mer motif
YGNANTV

SEQ ID NO: 8113 - protein, 7 aa, synthetic construct
  REGION 1..7: note = n-mer motif
QNDKSDN

SEQ ID NO: 8114 - protein, 7 aa, synthetic construct
  REGION 1..7: note = n-mer motif
SQAQIRV

SEQ ID NO: 8115 - protein, 7 aa, synthetic construct
  REGION 1..7: note = n-mer motif
FQRDVGH

SEQ ID NO: 8116 - protein, 7 aa, synthetic construct
  REGION 1..7: note = n-mer motif
LMNRNAP

SEQ ID NO: 8117 - protein, 7 aa, synthetic construct
  REGION 1..7: note = n-mer motif
AGSSPSR

SEQ ID NO: 8118 - protein, 7 aa, synthetic construct
  REGION 1..7: note = n-mer motif
LFHSQMT

SEQ ID NO: 8119 - protein, 7 aa, synthetic construct
  REGION 1..7: note = n-mer motif
MMSNSLA

SEQ ID NO: 8120 - protein, 7 aa, synthetic construct
  REGION 1..7: note = n-mer motif
VTTVLQS

SEQ ID NO: 8121 - protein, 7 aa, synthetic construct
  REGION 1..7: note = n-mer motif
GSQRAMN

SEQ ID NO: 8122 - protein, 7 aa, synthetic construct
  REGION 1..7: note = n-mer motif
ASGARYV

SEQ ID NO: 8123 - protein, 7 aa, synthetic construct
  REGION 1..7: note = n-mer motif
KNYDSDS

SEQ ID NO: 8124 - protein, 7 aa, synthetic construct
  REGION 1..7: note = n-mer motif
VGSGVGV

SEQ ID NO: 8125 - protein, 7 aa, synthetic construct
  REGION 1..7: note = n-mer motif
RSDLTES

SEQ ID NO: 8126 - protein, 7 aa, synthetic construct
  REGION 1..7: note = n-mer motif
RAEFIDT

SEQ ID NO: 8127 - protein, 7 aa, synthetic construct
  REGION 1..7: note = n-mer motif
TSEMRTA

SEQ ID NO: 8128 - protein, 7 aa, synthetic construct
  REGION 1..7: note = n-mer motif
ELDHLSH

SEQ ID NO: 8129 - protein, 7 aa, synthetic construct
  REGION 1..7: note = n-mer motif
TQAGLAS

SEQ ID NO: 8130 - protein, 7 aa, synthetic construct
  REGION 1..7: note = n-mer motif
AAQHHDT

SEQ ID NO: 8131 - protein, 7 aa, synthetic construct
  REGION 1..7: note = n-mer motif
GGAHTRV

SEQ ID NO: 8132 - protein, 7 aa, synthetic construct
  REGION 1..7: note = n-mer motif
AYGIHEV

SEQ ID NO: 8133 - protein, 7 aa, synthetic construct
  REGION 1..7: note = n-mer motif
AMLRMEQ

SEQ ID NO: 8134 - protein, 7 aa, synthetic construct
  REGION 1..7: note = n-mer motif
TDRSRLG

SEQ ID NO: 8135 - protein, 7 aa, synthetic construct
  REGION 1..7: note = n-mer motif
EREPPKN

SEQ ID NO: 8136 - protein, 7 aa, synthetic construct
  REGION 1..7: note = n-mer motif
VVKEIKL

SEQ ID NO: 8137 - protein, 7 aa, synthetic construct
  REGION 1..7: note = n-mer motif
HTGQTPS

SEQ ID NO: 8138 - protein, 7 aa, synthetic construct
  REGION 1..7: note = n-mer motif
VSLSSPP

SEQ ID NO: 8139 - protein, 7 aa, synthetic construct
  REGION 1..7: note = n-mer motif
GAGNLGT

SEQ ID NO: 8140 - protein, 7 aa, synthetic construct
  REGION 1..7: note = n-mer motif
ARDDTIQ

SEQ ID NO: 8141 - protein, 7 aa, synthetic construct
  REGION 1..7: note = n-mer motif
GTYTNMP

SEQ ID NO: 8142 - protein, 7 aa, synthetic construct
  REGION 1..7: note = n-mer motif
MLGGFAQ

SEQ ID NO: 8143 - protein, 7 aa, synthetic construct
  REGION 1..7: note = n-mer motif
PSEMRAV

SEQ ID NO: 8144 - protein, 7 aa, synthetic construct
  REGION 1..7: note = n-mer motif
RISPENS

SEQ ID NO: 8145 - protein, 7 aa, synthetic construct
  REGION 1..7: note = n-mer motif
KMGGSQS

SEQ ID NO: 8146 - protein, 7 aa, synthetic construct
  REGION 1..7: note = n-mer motif
GLMAHVT

SEQ ID NO: 8147 - protein, 7 aa, synthetic construct
  REGION 1..7: note = n-mer motif
SRQTALT

SEQ ID NO: 8148 - protein, 7 aa, synthetic construct
  REGION 1..7: note = n-mer motif
SDLNLPP

SEQ ID NO: 8149 - protein, 7 aa, synthetic construct
  REGION 1..7: note = n-mer motif
YVSDYLH

SEQ ID NO: 8150 - protein, 7 aa, synthetic construct
  REGION 1..7: note = n-mer motif
TNDNSDR

SEQ ID NO: 8151 - protein, 7 aa, synthetic construct
  REGION 1..7: note = n-mer motif
YLMHDSA

SEQ ID NO: 8152 - protein, 7 aa, synthetic construct
  REGION 1..7: note = n-mer motif
GSRNGPT

SEQ ID NO: 8153 - protein, 7 aa, synthetic construct
  REGION 1..7: note = n-mer motif
KNGVIND

SEQ ID NO: 8154 - protein, 7 aa, synthetic construct
  REGION 1..7: note = n-mer motif
ESVANLK

SEQ ID NO: 8155 - protein, 7 aa, synthetic construct
  REGION 1..7: note = n-mer motif
ASDSTTP

SEQ ID NO: 8156 - protein, 7 aa, synthetic construct
  REGION 1..7: note = n-mer motif
LNVSSSK

SEQ ID NO: 8157 - protein, 7 aa, synthetic construct
  REGION 1..7: note = n-mer motif
EAKGFGH

SEQ ID NO: 8158 - protein, 7 aa, synthetic construct
  REGION 1..7: note = n-mer motif
GTSAESR

SEQ ID NO: 8159 - protein, 7 aa, synthetic construct
  REGION 1..7: note = n-mer motif
MHNLPSY

SEQ ID NO: 8160 - protein, 7 aa, synthetic construct
  REGION 1..7: note = n-mer motif
VFTEIES

SEQ ID NO: 8161 - protein, 7 aa, synthetic construct
  REGION 1..7: note = n-mer motif
TQTSTWT

SEQ ID NO: 8162 - protein, 7 aa, synthetic construct
  REGION 1..7: note = n-mer motif
PMNKDIL

SEQ ID NO: 8163 - protein, 7 aa, synthetic construct
  REGION 1..7: note = n-mer motif
KESEYRV

SEQ ID NO: 8164 - protein, 7 aa, synthetic construct
  REGION 1..7: note = n-mer motif
STNSEAV

SEQ ID NO: 8165 - protein, 7 aa, synthetic construct
  REGION 1..7: note = n-mer motif
DTANRST

SEQ ID NO: 8166 - protein, 7 aa, synthetic construct
  REGION 1..7: note = n-mer motif
PKAPLNN

SEQ ID NO: 8167 - protein, 7 aa, synthetic construct
  REGION 1..7: note = n-mer motif
LATYPSH

SEQ ID NO: 8168 - protein, 7 aa, synthetic construct
  REGION 1..7: note = n-mer motif
ATVQSVD

SEQ ID NO: 8169 - protein, 7 aa, synthetic construct
  REGION 1..7: note = n-mer motif
NSMGNGG

SEQ ID NO: 8170 - protein, 7 aa, synthetic construct
  REGION 1..7: note = n-mer motif
DHSEQNS

SEQ ID NO: 8171 - protein, 7 aa, synthetic construct
  REGION 1..7: note = n-mer motif
TFLPQLG

SEQ ID NO: 8172 - protein, 7 aa, synthetic construct
  REGION 1..7: note = n-mer motif
GFTNTSK

SEQ ID NO: 8173 - protein, 7 aa, synthetic construct
  REGION 1..7: note = n-mer motif
TMNYSHT

SEQ ID NO: 8174 - protein, 7 aa, synthetic construct
  REGION 1..7: note = n-mer motif
SIGFSVG

SEQ ID NO: 8175 - protein, 7 aa, synthetic construct
  REGION 1..7: note = n-mer motif
SENRAGN

SEQ ID NO: 8176 - protein, 7 aa, synthetic construct
  REGION 1..7: note = n-mer motif
SLNLHSV

SEQ ID NO: 8177 - protein, 7 aa, synthetic construct
  REGION 1..7: note = n-mer motif
HESHYVS

SEQ ID NO: 8178 - protein, 7 aa, synthetic construct
  REGION 1..7: note = n-mer motif
NVVNGMD

SEQ ID NO: 8179 - protein, 7 aa, synthetic construct
  REGION 1..7: note = n-mer motif
HSDKVSS

SEQ ID NO: 8180 - protein, 7 aa, synthetic construct
  REGION 1..7: note = n-mer motif
KSVGDGR

SEQ ID NO: 8181 - protein, 7 aa, synthetic construct
  REGION 1..7: note = n-mer motif
RQVEQSD

SEQ ID NO: 8182 - protein, 7 aa, synthetic construct
  REGION 1..7: note = n-mer motif
RELVNTD

SEQ ID NO: 8183 - protein, 7 aa, synthetic construct
  REGION 1..7: note = n-mer motif
NYRDITM

SEQ ID NO: 8184 - protein, 7 aa, synthetic construct
  REGION 1..7: note = n-mer motif
ASLDRLP

SEQ ID NO: 8185 - protein, 7 aa, synthetic construct
  REGION 1..7: note = n-mer motif
RQLASLP

SEQ ID NO: 8186 - protein, 7 aa, synthetic construct
  REGION 1..7: note = n-mer motif
VSKTKDS

SEQ ID NO: 8187 - protein, 7 aa, synthetic construct
  REGION 1..7: note = n-mer motif
NVYEGHR

SEQ ID NO: 8188 - protein, 7 aa, synthetic construct
  REGION 1..7: note = n-mer motif
LEQLRVP

SEQ ID NO: 8189 - protein, 7 aa, synthetic construct
  REGION 1..7: note = n-mer motif
MTYTSPT

SEQ ID NO: 8190 - protein, 7 aa, synthetic construct
  REGION 1..7: note = n-mer motif
NSHTDRG

SEQ ID NO: 8191 - protein, 7 aa, synthetic construct
  REGION 1..7: note = n-mer motif
VAGGTSE

SEQ ID NO: 8192 - protein, 7 aa, synthetic construct
  REGION 1..7: note = n-mer motif
VDAHRAN

SEQ ID NO: 8193 - protein, 7 aa, synthetic construct
  REGION 1..7: note = n-mer motif
RADMTPL

SEQ ID NO: 8194 - protein, 7 aa, synthetic construct
  REGION 1..7: note = n-mer motif
GHEQTDA

SEQ ID NO: 8195 - protein, 7 aa, synthetic construct
  REGION 1..7: note = n-mer motif
YIAGGDQ

SEQ ID NO: 8196 - protein, 7 aa, synthetic construct
  REGION 1..7: note = n-mer motif
YGDLTTV

SEQ ID NO: 8197 - protein, 7 aa, synthetic construct
  REGION 1..7: note = n-mer motif
RLDLQEH

SEQ ID NO: 8198 - protein, 7 aa, synthetic construct
  REGION 1..7: note = n-mer motif
HLNPAAQ

SEQ ID NO: 8199 - protein, 7 aa, synthetic construct
  REGION 1..7: note = n-mer motif
GVNEQTN

SEQ ID NO: 8200 - protein, 7 aa, synthetic construct
  REGION 1..7: note = n-mer motif
RRLSTDL

SEQ ID NO: 8201 - protein, 7 aa, synthetic construct
  REGION 1..7: note = n-mer motif
GSTGLPP

SEQ ID NO: 8202 - protein, 7 aa, synthetic construct
  REGION 1..7: note = n-mer motif
DDMVKNS

SEQ ID NO: 8203 - protein, 7 aa, synthetic construct
  REGION 1..7: note = n-mer motif
VIDLVTR

SEQ ID NO: 8204 - protein, 7 aa, synthetic construct
  REGION 1..7: note = n-mer motif
GGLTNGL

SEQ ID NO: 8205 - protein, 7 aa, synthetic construct
  REGION 1..7: note = n-mer motif
RMEETAY

SEQ ID NO: 8206 - protein, 7 aa, synthetic construct
  REGION 1..7: note = n-mer motif
TDISGYG

SEQ ID NO: 8207 - protein, 7 aa, synthetic construct
  REGION 1..7: note = n-mer motif
QVNHNTS

SEQ ID NO: 8208 - protein, 7 aa, synthetic construct
  REGION 1..7: note = n-mer motif
ATTEDVR

SEQ ID NO: 8209 - protein, 7 aa, synthetic construct
  REGION 1..7: note = n-mer motif
WSIKNQT

SEQ ID NO: 8210 - protein, 7 aa, synthetic construct
  REGION 1..7: note = n-mer motif
SPTSNTI

SEQ ID NO: 8211 - protein, 7 aa, synthetic construct
  REGION 1..7: note = n-mer motif
MKNSGFD

SEQ ID NO: 8212 - protein, 7 aa, synthetic construct
  REGION 1..7: note = n-mer motif
LVAERLP

SEQ ID NO: 8213 - protein, 7 aa, synthetic construct
  REGION 1..7: note = n-mer motif
GETNFPT

SEQ ID NO: 8214 - protein, 7 aa, synthetic construct
  REGION 1..7: note = n-mer motif
NGKLGTT

SEQ ID NO: 8215 - protein, 7 aa, synthetic construct
  REGION 1..7: note = n-mer motif
NLVAYTK

SEQ ID NO: 8216 - protein, 7 aa, synthetic construct
  REGION 1..7: note = n-mer motif
WQLTTSH

SEQ ID NO: 8217 - protein, 7 aa, synthetic construct
  REGION 1..7: note = n-mer motif
SLDLGGN

SEQ ID NO: 8218 - protein, 7 aa, synthetic construct
  REGION 1..7: note = n-mer motif
NESTKES

SEQ ID NO: 8219 - protein, 7 aa, synthetic construct
  REGION 1..7: note = n-mer motif
GFDGKQL

SEQ ID NO: 8220 - protein, 7 aa, synthetic construct
  REGION 1..7: note = n-mer motif
HLYISAD

SEQ ID NO: 8221 - protein, 7 aa, synthetic construct
  REGION 1..7: note = n-mer motif
LLPNNTH

SEQ ID NO: 8222 - protein, 7 aa, synthetic construct
  REGION 1..7: note = n-mer motif
SGMAGLS

SEQ ID NO: 8223 - protein, 7 aa, synthetic construct
  REGION 1..7: note = n-mer motif
ITSLPET

SEQ ID NO: 8224 - protein, 7 aa, synthetic construct
  REGION 1..7: note = n-mer motif
ELKESQK

SEQ ID NO: 8225 - protein, 7 aa, synthetic construct
  REGION 1..7: note = n-mer motif
NIVQDYP

SEQ ID NO: 8226 - protein, 7 aa, synthetic construct
  REGION 1..7: note = n-mer motif
SENTSVP

SEQ ID NO: 8227 - protein, 7 aa, synthetic construct
  REGION 1..7: note = n-mer motif
DPNQPKT

SEQ ID NO: 8228 - protein, 7 aa, synthetic construct
  REGION 1..7: note = n-mer motif
AGLDVNT

SEQ ID NO: 8229 - protein, 7 aa, synthetic construct
  REGION 1..7: note = n-mer motif
SHEMNNG

SEQ ID NO: 8230 - protein, 7 aa, synthetic construct
  REGION 1..7: note = n-mer motif
SYAINQS

SEQ ID NO: 8231 - protein, 7 aa, synthetic construct
  REGION 1..7: note = n-mer motif
GHLPAAK

SEQ ID NO: 8232 - protein, 7 aa, synthetic construct
  REGION 1..7: note = n-mer motif
ELGNKTA

SEQ ID NO: 8233 - protein, 7 aa, synthetic construct
  REGION 1..7: note = n-mer motif
LESTRKA

SEQ ID NO: 8234 - protein, 7 aa, synthetic construct
  REGION 1..7: note = n-mer motif
TQGNSEA

SEQ ID NO: 8235 - protein, 7 aa, synthetic construct
  REGION 1..7: note = n-mer motif
ISIDSAM

SEQ ID NO: 8236 - protein, 7 aa, synthetic construct
  REGION 1..7: note = n-mer motif
EFQRIRE

SEQ ID NO: 8237 - protein, 7 aa, synthetic construct
  REGION 1..7: note = n-mer motif
ASLSAPA

SEQ ID NO: 8238 - protein, 7 aa, synthetic construct
  REGION 1..7: note = n-mer motif
DSQITRL

SEQ ID NO: 8239 - protein, 7 aa, synthetic construct
  REGION 1..7: note = n-mer motif
GHENMGV

SEQ ID NO: 8240 - protein, 7 aa, synthetic construct
  REGION 1..7: note = n-mer motif
MSAGHPT

SEQ ID NO: 8241 - protein, 7 aa, synthetic construct
  REGION 1..7: note = n-mer motif
HAPSGAI

SEQ ID NO: 8242 - protein, 7 aa, synthetic construct
  REGION 1..7: note = n-mer motif
TTITNSV

SEQ ID NO: 8243 - protein, 7 aa, synthetic construct
  REGION 1..7: note = n-mer motif
PQHQHEH

SEQ ID NO: 8244 - protein, 7 aa, synthetic construct
  REGION 1..7: note = n-mer motif
QYSMDTR

SEQ ID NO: 8245 - protein, 7 aa, synthetic construct
  REGION 1..7: note = n-mer motif
LYEVGTP

SEQ ID NO: 8246 - protein, 7 aa, synthetic construct
  REGION 1..7: note = n-mer motif
GETMRHN

SEQ ID NO: 8247 - protein, 7 aa, synthetic construct
  REGION 1..7: note = n-mer motif
MTITVEP

SEQ ID NO: 8248 - protein, 7 aa, synthetic construct
  REGION 1..7: note = n-mer motif
AQHPERS

SEQ ID NO: 8249 - protein, 7 aa, synthetic construct
  REGION 1..7: note = n-mer motif
THVAKPD

SEQ ID NO: 8250 - protein, 7 aa, synthetic construct
  REGION 1..7: note = n-mer motif
MTANLVE

SEQ ID NO: 8251 - protein, 7 aa, synthetic construct
  REGION 1..7: note = n-mer motif
NRQRDFE

SEQ ID NO: 8252 - protein, 7 aa, synthetic construct
  REGION 1..7: note = n-mer motif
SNSADAG

SEQ ID NO: 8253 - protein, 7 aa, synthetic construct
  REGION 1..7: note = n-mer motif
GEYGASV

SEQ ID NO: 8254 - protein, 7 aa, synthetic construct
  REGION 1..7: note = n-mer motif
DGMVRST

SEQ ID NO: 8255 - protein, 7 aa, synthetic construct
  REGION 1..7: note = n-mer motif
NGQLLAN

SEQ ID NO: 8256 - protein, 7 aa, synthetic construct
  REGION 1..7: note = n-mer motif
SAGMTLD

SEQ ID NO: 8257 - protein, 7 aa, synthetic construct
  REGION 1..7: note = n-mer motif
DHVHLTY

SEQ ID NO: 8258 - protein, 7 aa, synthetic construct
  REGION 1..7: note = n-mer motif
TTLTQTD

SEQ ID NO: 8259 - protein, 7 aa, synthetic construct
  REGION 1..7: note = n-mer motif
VQLADGH

SEQ ID NO: 8260 - protein, 7 aa, synthetic construct
  REGION 1..7: note = n-mer motif
TDSSADS

SEQ ID NO: 8261 - protein, 7 aa, synthetic construct
  REGION 1..7: note = n-mer motif
AMNVRSD

SEQ ID NO: 8262 - protein, 7 aa, synthetic construct
  REGION 1..7: note = n-mer motif
GDISYRV

SEQ ID NO: 8263 - protein, 7 aa, synthetic construct
  REGION 1..7: note = n-mer motif
MGYVDSL

SEQ ID NO: 8264 - protein, 7 aa, synthetic construct
  REGION 1..7: note = n-mer motif
LYLAAAS

SEQ ID NO: 8265 - protein, 7 aa, synthetic construct
  REGION 1..7: note = n-mer motif
SSPDSYR

SEQ ID NO: 8266 - protein, 7 aa, synthetic construct
  REGION 1..7: note = n-mer motif
SYNVDLH

SEQ ID NO: 8267 - protein, 7 aa, synthetic construct
  REGION 1..7: note = n-mer motif
QHTAHPM

SEQ ID NO: 8268 - protein, 7 aa, synthetic construct
  REGION 1..7: note = n-mer motif
AVMATHP

SEQ ID NO: 8269 - protein, 7 aa, synthetic construct
  REGION 1..7: note = n-mer motif
ISPSASN

SEQ ID NO: 8270 - protein, 7 aa, synthetic construct
  REGION 1..7: note = n-mer motif
TLDNNHS

SEQ ID NO: 8271 - protein, 7 aa, synthetic construct
  REGION 1..7: note = n-mer motif
SGSYVAT

SEQ ID NO: 8272 - protein, 7 aa, synthetic construct
  REGION 1..7: note = n-mer motif
MAAPPEH

SEQ ID NO: 8273 - protein, 7 aa, synthetic construct
  REGION 1..7: note = n-mer motif
QTASGDT

SEQ ID NO: 8274 - protein, 7 aa, synthetic construct
  REGION 1..7: note = n-mer motif
ESKTVVI

SEQ ID NO: 8275 - protein, 7 aa, synthetic construct
  REGION 1..7: note = n-mer motif
TVLPQSD

SEQ ID NO: 8276 - protein, 7 aa, synthetic construct
  REGION 1..7: note = n-mer motif
PLNANGS

SEQ ID NO: 8277 - protein, 7 aa, synthetic construct
  REGION 1..7: note = n-mer motif
PLNTGLT

SEQ ID NO: 8278 - protein, 7 aa, synthetic construct
  REGION 1..7: note = n-mer motif
AITIIGT

SEQ ID NO: 8279 - protein, 7 aa, synthetic construct
  REGION 1..7: note = n-mer motif
NPSAISY

SEQ ID NO: 8280 - protein, 7 aa, synthetic construct
  REGION 1..7: note = n-mer motif
TEHEKST

SEQ ID NO: 8281 - protein, 7 aa, synthetic construct
  REGION 1..7: note = n-mer motif
AESQLAS

SEQ ID NO: 8282 - protein, 7 aa, synthetic construct
  REGION 1..7: note = n-mer motif
VLKGTFP

SEQ ID NO: 8283 - protein, 7 aa, synthetic construct
  REGION 1..7: note = n-mer motif
SFAEITT

SEQ ID NO: 8284 - protein, 7 aa, synthetic construct
  REGION 1..7: note = n-mer motif
PLNGRVT

SEQ ID NO: 8285 - protein, 7 aa, synthetic construct
  REGION 1..7: note = n-mer motif
SERPQSS

SEQ ID NO: 8286 - protein, 7 aa, synthetic construct
  REGION 1..7: note = n-mer motif
AQLQDSV

SEQ ID NO: 8287 - protein, 7 aa, synthetic construct
  REGION 1..7: note = n-mer motif
PNRVTAP

SEQ ID NO: 8288 - protein, 7 aa, synthetic construct
  REGION 1..7: note = n-mer motif
ALIVSSM

SEQ ID NO: 8289 - protein, 7 aa, synthetic construct
  REGION 1..7: note = n-mer motif
AHGAFPV

SEQ ID NO: 8290 - protein, 7 aa, synthetic construct
  REGION 1..7: note = n-mer motif
EAYQTEK

SEQ ID NO: 8291 - protein, 7 aa, synthetic construct
  REGION 1..7: note = n-mer motif
AAASPLA

SEQ ID NO: 8292 - protein, 7 aa, synthetic construct
  REGION 1..7: note = n-mer motif
PQATLNN

SEQ ID NO: 8293 - protein, 7 aa, synthetic construct
  REGION 1..7: note = n-mer motif
TRGDMEF

SEQ ID NO: 8294 - protein, 7 aa, synthetic construct
  REGION 1..7: note = n-mer motif
SNLGEAS

SEQ ID NO: 8295 - protein, 7 aa, synthetic construct
  REGION 1..7: note = n-mer motif
GITGSPG

SEQ ID NO: 8296 - protein, 7 aa, synthetic construct
  REGION 1..7: note = n-mer motif
GFETSSP

SEQ ID NO: 8297 - protein, 7 aa, synthetic construct
  REGION 1..7: note = n-mer motif
PARSDAL

SEQ ID NO: 8298 - protein, 7 aa, synthetic construct
  REGION 1..7: note = n-mer motif
HANYVEV

SEQ ID NO: 8299 - protein, 7 aa, synthetic construct
  REGION 1..7: note = n-mer motif
VTRSTKE

SEQ ID NO: 8300 - protein, 7 aa, synthetic construct
  REGION 1..7: note = n-mer motif
DVALRSN

SEQ ID NO: 8301 - protein, 7 aa, synthetic construct
  REGION 1..7: note = n-mer motif
ESDLRQR

SEQ ID NO: 8302 - protein, 7 aa, synthetic construct
  REGION 1..7: note = n-mer motif
PLLAANP

SEQ ID NO: 8303 - protein, 7 aa, synthetic construct
  REGION 1..7: note = n-mer motif
INAAHRP

SEQ ID NO: 8304 - protein, 7 aa, synthetic construct
  REGION 1..7: note = n-mer motif
ARRDVNS

SEQ ID NO: 8305 - protein, 7 aa, synthetic construct
  REGION 1..7: note = n-mer motif
SMDKVEK

SEQ ID NO: 8306 - protein, 7 aa, synthetic construct
  REGION 1..7: note = n-mer motif
NVSARET

SEQ ID NO: 8307 - protein, 7 aa, synthetic construct
  REGION 1..7: note = n-mer motif
LTTAGMW

SEQ ID NO: 8308 - protein, 7 aa, synthetic construct
  REGION 1..7: note = n-mer motif
ARAEGVF

SEQ ID NO: 8309 - protein, 7 aa, synthetic construct
  REGION 1..7: note = n-mer motif
PSDHMRT

SEQ ID NO: 8310 - protein, 7 aa, synthetic construct
  REGION 1..7: note = n-mer motif
SRTVILS

SEQ ID NO: 8311 - protein, 7 aa, synthetic construct
  REGION 1..7: note = n-mer motif
QSNAAEG

SEQ ID NO: 8312 - protein, 7 aa, synthetic construct
  REGION 1..7: note = n-mer motif
WTETAAH

SEQ ID NO: 8313 - protein, 7 aa, synthetic construct
  REGION 1..7: note = n-mer motif
KENQLSK

SEQ ID NO: 8314 - protein, 7 aa, synthetic construct
  REGION 1..7: note = n-mer motif
RGDYHAI

SEQ ID NO: 8315 - protein, 7 aa, synthetic construct
  REGION 1..7: note = n-mer motif
RGDYASL

SEQ ID NO: 8316 - protein, 7 aa, synthetic construct
  REGION 1..7: note = n-mer motif
RGDYVGL

SEQ ID NO: 8317 - protein, 7 aa, synthetic construct
  REGION 1..7: note = n-mer motif
RGDLRPT

SEQ ID NO: 8318 - protein, 7 aa, synthetic construct
  REGION 1..7: note = n-mer motif
RGDHVSL

SEQ ID NO: 8319 - protein, 7 aa, synthetic construct
  REGION 1..7: note = n-mer motif
DVRSLHG

SEQ ID NO: 8320 - protein, 7 aa, synthetic construct
  REGION 1..7: note = n-mer motif
RGDYHAI

SEQ ID NO: 8321 - protein, 7 aa, synthetic construct
  REGION 1..7: note = n-mer motif
RGDYGGL

SEQ ID NO: 8322 - protein, 7 aa, synthetic construct
  REGION 1..7: note = n-mer motif
RGDHGVL

SEQ ID NO: 8323 - protein, 7 aa, synthetic construct
  REGION 1..7: note = n-mer motif
RGDYREL

SEQ ID NO: 8324 - protein, 7 aa, synthetic construct
  REGION 1..7: note = n-mer motif
VSRGDVP

SEQ ID NO: 8325 - protein, 7 aa, synthetic construct
  REGION 1..7: note = n-mer motif
RGDYVGL

SEQ ID NO: 8326 - protein, 7 aa, synthetic construct
  REGION 1..7: note = n-mer motif
RGDYSGL

SEQ ID NO: 8327 - protein, 7 aa, synthetic construct
  REGION 1..7: note = n-mer motif
RGDLTVT

SEQ ID NO: 8328 - protein, 7 aa, synthetic construct
  REGION 1..7: note = n-mer motif
RGDHASW

SEQ ID NO: 8329 - protein, 7 aa, synthetic construct
  REGION 1..7: note = n-mer motif
RGDLVGY

SEQ ID NO: 8330 - protein, 7 aa, synthetic construct
  REGION 1..7: note = n-mer motif
RGDGAAM

SEQ ID NO: 8331 - protein, 7 aa, synthetic construct
  REGION 1..7: note = n-mer motif
VSAARSL

SEQ ID NO: 8332 - protein, 7 aa, synthetic construct
  REGION 1..7: note = n-mer motif
LTAQYVT

SEQ ID NO: 8333 - protein, 7 aa, synthetic construct
  REGION 1..7: note = n-mer motif
RGDHGVL

SEQ ID NO: 8334 - protein, 7 aa, synthetic construct
  REGION 1..7: note = n-mer motif
VGNRFSP

SEQ ID NO: 8335 - protein, 7 aa, synthetic construct
  REGION 1..7: note = n-mer motif
TGVHTRV

SEQ ID NO: 8336 - protein, 7 aa, synthetic construct
  REGION 1..7: note = n-mer motif
VRTGDAS

SEQ ID NO: 8337 - protein, 7 aa, synthetic construct
  REGION 1..7: note = n-mer motif
MVVRGGV

SEQ ID NO: 8338 - protein, 7 aa, synthetic construct
  REGION 1..7: note = n-mer motif
RGDRESH

SEQ ID NO: 8339 - protein, 7 aa, synthetic construct
  REGION 1..7: note = n-mer motif
RGDYSGL

SEQ ID NO: 8340 - protein, 7 aa, synthetic construct
  REGION 1..7: note = n-mer motif
RGDLSSV

SEQ ID NO: 8341 - protein, 7 aa, synthetic construct
  REGION 1..7: note = n-mer motif
LLGQRAA

SEQ ID NO: 8342 - protein, 7 aa, synthetic construct
  REGION 1..7: note = n-mer motif
GKGTVPS

SEQ ID NO: 8343 - protein, 7 aa, synthetic construct
  REGION 1..7: note = n-mer motif
SSIGVKI

SEQ ID NO: 8344 - protein, 7 aa, synthetic construct
  REGION 1..7: note = n-mer motif
ANKGLGT

SEQ ID NO: 8345 - protein, 7 aa, synthetic construct
  REGION 1..7: note = n-mer motif
RGDHASW

SEQ ID NO: 8346 - protein, 7 aa, synthetic construct
  REGION 1..7: note = n-mer motif
RGDRLVI

SEQ ID NO: 8347 - protein, 7 aa, synthetic construct
  REGION 1..7: note = n-mer motif
GQGHRGD

SEQ ID NO: 8348 - protein, 7 aa, synthetic construct
  REGION 1..7: note = n-mer motif
ERTRAGE

SEQ ID NO: 8349 - protein, 7 aa, synthetic construct
  REGION 1..7: note = n-mer motif
RGDLSGT

SEQ ID NO: 8350 - protein, 7 aa, synthetic construct
  REGION 1..7: note = n-mer motif
RGDYREM

SEQ ID NO: 8351 - protein, 7 aa, synthetic construct
  REGION 1..7: note = n-mer motif
RGDLAHN

SEQ ID NO: 8352 - protein, 7 aa, synthetic construct
  REGION 1..7: note = n-mer motif
GFSGRTV

SEQ ID NO: 8353 - protein, 7 aa, synthetic construct
  REGION 1..7: note = n-mer motif
VMRAGAT

SEQ ID NO: 8354 - protein, 7 aa, synthetic construct
  REGION 1..7: note = n-mer motif
EGGIYRV

SEQ ID NO: 8355 - protein, 7 aa, synthetic construct
  REGION 1..7: note = n-mer motif
RGDYREL

SEQ ID NO: 8356 - protein, 7 aa, synthetic construct
  REGION 1..7: note = n-mer motif
QSVSIKS

SEQ ID NO: 8357 - protein, 7 aa, synthetic construct
  REGION 1..7: note = n-mer motif
RGDLVHV

SEQ ID NO: 8358 - protein, 7 aa, synthetic construct
  REGION 1..7: note = n-mer motif
YRGDIRV

SEQ ID NO: 8359 - protein, 8 aa, synthetic construct
  REGION 1..8: note = n-mer motif
QRGDASTW

SEQ ID NO: 8360 - protein, 7 aa, synthetic construct
  REGION 1..7: note = n-mer motif
RGDYGGI

SEQ ID NO: 8361 - protein, 7 aa, synthetic construct
  REGION 1..7: note = n-mer motif
VGTRGDT

SEQ ID NO: 8362 - protein, 7 aa, synthetic construct
  REGION 1..7: note = n-mer motif
RGDLTTV

SEQ ID NO: 8363 - protein, 7 aa, synthetic construct
  REGION 1..7: note = n-mer motif
RGDMRPV

SEQ ID NO: 8364 - protein, 7 aa, synthetic construct
  REGION 1..7: note = n-mer motif
AAGRLTT

SEQ ID NO: 8365 - protein, 7 aa, synthetic construct
  REGION 1..7: note = n-mer motif
NAGRSTL

SEQ ID NO: 8366 - protein, 7 aa, synthetic construct
  REGION 1..7: note = n-mer motif
ERDRISG

SEQ ID NO: 8367 - protein, 7 aa, synthetic construct
  REGION 1..7: note = n-mer motif
RGDLTTT

SEQ ID NO: 8368 - protein, 7 aa, synthetic construct
  REGION 1..7: note = n-mer motif
TTGLRLA

SEQ ID NO: 8369 - protein, 7 aa, synthetic construct
  REGION 1..7: note = n-mer motif
RGDHSGW

SEQ ID NO: 8370 - protein, 7 aa, synthetic construct
  REGION 1..7: note = n-mer motif
SGGTYLA

SEQ ID NO: 8371 - protein, 7 aa, synthetic construct
  REGION 1..7: note = n-mer motif
AVVRGGP

SEQ ID NO: 8372 - protein, 7 aa, synthetic construct
  REGION 1..7: note = n-mer motif
IVRGLSD

SEQ ID NO: 8373 - protein, 7 aa, synthetic construct
  REGION 1..7: note = n-mer motif
RGDTMRL

SEQ ID NO: 8374 - protein, 7 aa, synthetic construct
  REGION 1..7: note = n-mer motif
TRVPVSG

SEQ ID NO: 8375 - protein, 7 aa, synthetic construct
  REGION 1..7: note = n-mer motif
RTYDSNV

SEQ ID NO: 8376 - protein, 7 aa, synthetic construct
  REGION 1..7: note = n-mer motif
RGDRMGV

SEQ ID NO: 8377 - protein, 7 aa, synthetic construct
  REGION 1..7: note = n-mer motif
QLNAYSG

SEQ ID NO: 8378 - protein, 7 aa, synthetic construct
  REGION 1..7: note = n-mer motif
SLGITSG

SEQ ID NO: 8379 - protein, 7 aa, synthetic construct
  REGION 1..7: note = n-mer motif
TAAVRTY

SEQ ID NO: 8380 - protein, 7 aa, synthetic construct
  REGION 1..7: note = n-mer motif
RGDLTTT

SEQ ID NO: 8381 - protein, 7 aa, synthetic construct
  REGION 1..7: note = n-mer motif
RGDYATF

SEQ ID NO: 8382 - protein, 7 aa, synthetic construct
  REGION 1..7: note = n-mer motif
RGDIVGL

SEQ ID NO: 8383 - protein, 7 aa, synthetic construct
  REGION 1..7: note = n-mer motif
GSRGDLS

SEQ ID NO: 8384 - protein, 7 aa, synthetic construct
  REGION 1..7: note = n-mer motif
RGDVTHI

SEQ ID NO: 8385 - protein, 7 aa, synthetic construct
  REGION 1..7: note = n-mer motif
IGGTRVQ

SEQ ID NO: 8386 - protein, 7 aa, synthetic construct
  REGION 1..7: note = n-mer motif
ENHTHRA

SEQ ID NO: 8387 - protein, 7 aa, synthetic construct
  REGION 1..7: note = n-mer motif
RGDLTYA

SEQ ID NO: 8388 - protein, 7 aa, synthetic construct
  REGION 1..7: note = n-mer motif
LLHESRV

SEQ ID NO: 8389 - protein, 7 aa, synthetic construct
  REGION 1..7: note = n-mer motif
RGDVSGI

SEQ ID NO: 8390 - protein, 7 aa, synthetic construct
  REGION 1..7: note = n-mer motif
LNSAMRT

SEQ ID NO: 8391 - protein, 7 aa, synthetic construct
  REGION 1..7: note = n-mer motif
RGDYATL

SEQ ID NO: 8392 - protein, 7 aa, synthetic construct
  REGION 1..7: note = n-mer motif
SANVVRG

SEQ ID NO: 8393 - protein, 7 aa, synthetic construct
  REGION 1..7: note = n-mer motif
VAGQRSV

SEQ ID NO: 8394 - protein, 7 aa, synthetic construct
  REGION 1..7: note = n-mer motif
RGDREHF

SEQ ID NO: 8395 - protein, 7 aa, synthetic construct
  REGION 1..7: note = n-mer motif
RGDYVTI

SEQ ID NO: 8396 - protein, 7 aa, synthetic construct
  REGION 1..7: note = n-mer motif
RLVSTAP

SEQ ID NO: 8397 - protein, 7 aa, synthetic construct
  REGION 1..7: note = n-mer motif
HQSFHGA

SEQ ID NO: 8398 - protein, 7 aa, synthetic construct
  REGION 1..7: note = n-mer motif
VRGDSRF

SEQ ID NO: 8399 - protein, 7 aa, synthetic construct
  REGION 1..7: note = n-mer motif
RGDFGGV

SEQ ID NO: 8400 - protein, 7 aa, synthetic construct
  REGION 1..7: note = n-mer motif
LVRTTVS

SEQ ID NO: 8401 - protein, 7 aa, synthetic construct
  REGION 1..7: note = n-mer motif
RGDYVSV

SEQ ID NO: 8402 - protein, 7 aa, synthetic construct
  REGION 1..7: note = n-mer motif
RGDYASL

SEQ ID NO: 8403 - protein, 7 aa, synthetic construct
  REGION 1..7: note = n-mer motif
IVRDGRL

SEQ ID NO: 8404 - protein, 7 aa, synthetic construct
  REGION 1..7: note = n-mer motif
LTHGMIG

SEQ ID NO: 8405 - protein, 7 aa, synthetic construct
  REGION 1..7: note = n-mer motif
RGDVRVI

SEQ ID NO: 8406 - protein, 7 aa, synthetic construct
  REGION 1..7: note = n-mer motif
KAQPSSS

SEQ ID NO: 8407 - protein, 7 aa, synthetic construct
  REGION 1..7: note = n-mer motif
GMRGASV

SEQ ID NO: 8408 - protein, 7 aa, synthetic construct
  REGION 1..7: note = n-mer motif
AAGRVGT

SEQ ID NO: 8409 - protein, 7 aa, synthetic construct
  REGION 1..7: note = n-mer motif
QMGRVQV

SEQ ID NO: 8410 - protein, 7 aa, synthetic construct
  REGION 1..7: note = n-mer motif
LMSRGDT

SEQ ID NO: 8411 - protein, 7 aa, synthetic construct
  REGION 1..7: note = n-mer motif
VHSRGDM

SEQ ID NO: 8412 - protein, 7 aa, synthetic construct
  REGION 1..7: note = n-mer motif
RGDLVTV

SEQ ID NO: 8413 - protein, 7 aa, synthetic construct
  REGION 1..7: note = n-mer motif
RNYGDHS

SEQ ID NO: 8414 - protein, 7 aa, synthetic construct
  REGION 1..7: note = n-mer motif
RGDYSQI

SEQ ID NO: 8415 - protein, 7 aa, synthetic construct
  REGION 1..7: note = n-mer motif
RGDLANS

SEQ ID NO: 8416 - protein, 7 aa, synthetic construct
  REGION 1..7: note = n-mer motif
RSSHLDV

SEQ ID NO: 8417 - protein, 7 aa, synthetic construct
  REGION 1..7: note = n-mer motif
RSGTVGL

SEQ ID NO: 8418 - protein, 7 aa, synthetic construct
  REGION 1..7: note = n-mer motif
IGARGDT

SEQ ID NO: 8419 - protein, 7 aa, synthetic construct
  REGION 1..7: note = n-mer motif
SNAVPGT

SEQ ID NO: 8420 - protein, 7 aa, synthetic construct
  REGION 1..7: note = n-mer motif
LDARGHL

SEQ ID NO: 8421 - protein, 7 aa, synthetic construct
  REGION 1..7: note = n-mer motif
TSVSVKY

SEQ ID NO: 8422 - protein, 7 aa, synthetic construct
  REGION 1..7: note = n-mer motif
TRVMGAT

SEQ ID NO: 8423 - protein, 7 aa, synthetic construct
  REGION 1..7: note = n-mer motif
RGGTGVN

SEQ ID NO: 8424 - protein, 7 aa, synthetic construct
  REGION 1..7: note = n-mer motif
VASRTSV

SEQ ID NO: 8425 - protein, 7 aa, synthetic construct
  REGION 1..7: note = n-mer motif
RGDRLQI

SEQ ID NO: 8426 - protein, 7 aa, synthetic construct
  REGION 1..7: note = n-mer motif
RGDYERL

SEQ ID NO: 8427 - protein, 7 aa, synthetic construct
  REGION 1..7: note = n-mer motif
LAAKALV

SEQ ID NO: 8428 - protein, 7 aa, synthetic construct
  REGION 1..7: note = n-mer motif
LGTTSAS

SEQ ID NO: 8429 - protein, 7 aa, synthetic construct
  REGION 1..7: note = n-mer motif
RGDHGTI

SEQ ID NO: 8430 - protein, 7 aa, synthetic construct
  REGION 1..7: note = n-mer motif
GLRVVQA

SEQ ID NO: 8431 - protein, 7 aa, synthetic construct
  REGION 1..7: note = n-mer motif
RQTVGMG

SEQ ID NO: 8432 - protein, 7 aa, synthetic construct
  REGION 1..7: note = n-mer motif
RGDLLTN

SEQ ID NO: 8433 - protein, 7 aa, synthetic construct
  REGION 1..7: note = n-mer motif
YGHGMVG

SEQ ID NO: 8434 - protein, 7 aa, synthetic construct
  REGION 1..7: note = n-mer motif
VVAALRG

SEQ ID NO: 8435 - protein, 7 aa, synthetic construct
  REGION 1..7: note = n-mer motif
QLSRSGT

SEQ ID NO: 8436 - protein, 7 aa, synthetic construct
  REGION 1..7: note = n-mer motif
GLSRTGV

SEQ ID NO: 8437 - protein, 7 aa, synthetic construct
  REGION 1..7: note = n-mer motif
MGGGRLT

SEQ ID NO: 8438 - protein, 7 aa, synthetic construct
  REGION 1..7: note = n-mer motif
RGDLVMV

SEQ ID NO: 8439 - protein, 7 aa, synthetic construct
  REGION 1..7: note = n-mer motif
RGDVVGL

SEQ ID NO: 8440 - protein, 7 aa, synthetic construct
  REGION 1..7: note = n-mer motif
VTKVGVL

SEQ ID NO: 8441 - protein, 7 aa, synthetic construct
  REGION 1..7: note = n-mer motif
RTSYPEA

SEQ ID NO: 8442 - protein, 7 aa, synthetic construct
  REGION 1..7: note = n-mer motif
ESRATMS

SEQ ID NO: 8443 - protein, 7 aa, synthetic construct
  REGION 1..7: note = n-mer motif
SRVGVGA

SEQ ID NO: 8444 - protein, 7 aa, synthetic construct
  REGION 1..7: note = n-mer motif
RGDYVTM

SEQ ID NO: 8445 - protein, 7 aa, synthetic construct
  REGION 1..7: note = n-mer motif
RAQGPQA

SEQ ID NO: 8446 - protein, 7 aa, synthetic construct
  REGION 1..7: note = n-mer motif
VTSHAMA

SEQ ID NO: 8447 - protein, 7 aa, synthetic construct
  REGION 1..7: note = n-mer motif
RGDLGGV

SEQ ID NO: 8448 - protein, 7 aa, synthetic construct
  REGION 1..7: note = n-mer motif
SIRGELG

SEQ ID NO: 8449 - protein, 7 aa, synthetic construct
  REGION 1..7: note = n-mer motif
RGDGSAL

SEQ ID NO: 8450 - protein, 7 aa, synthetic construct
  REGION 1..7: note = n-mer motif
SRSGIAI

SEQ ID NO: 8451 - protein, 7 aa, synthetic construct
  REGION 1..7: note = n-mer motif
QAGTLGY

SEQ ID NO: 8452 - protein, 7 aa, synthetic construct
  REGION 1..7: note = n-mer motif
RGDLTTA

SEQ ID NO: 8453 - protein, 7 aa, synthetic construct
  REGION 1..7: note = n-mer motif
LGHRGDV

SEQ ID NO: 8454 - protein, 7 aa, synthetic construct
  REGION 1..7: note = n-mer motif
RGDLTIT

SEQ ID NO: 8455 - protein, 7 aa, synthetic construct
  REGION 1..7: note = n-mer motif
RGDLRVP

SEQ ID NO: 8456 - protein, 7 aa, synthetic construct
  REGION 1..7: note = n-mer motif
NSDHRIL

SEQ ID NO: 8457 - protein, 7 aa, synthetic construct
  REGION 1..7: note = n-mer motif
RGDYHSF

SEQ ID NO: 8458 - protein, 7 aa, synthetic construct
  REGION 1..7: note = n-mer motif
GTGRYVS

SEQ ID NO: 8459 - protein, 7 aa, synthetic construct
  REGION 1..7: note = n-mer motif
PLLRSGT

SEQ ID NO: 8460 - protein, 7 aa, synthetic construct
  REGION 1..7: note = n-mer motif
RGDVVSW

SEQ ID NO: 8461 - protein, 7 aa, synthetic construct
  REGION 1..7: note = n-mer motif
VMRVGHA

SEQ ID NO: 8462 - protein, 7 aa, synthetic construct
  REGION 1..7: note = n-mer motif
RGDLVSV

SEQ ID NO: 8463 - protein, 7 aa, synthetic construct
  REGION 1..7: note = n-mer motif
RGDLTGV

SEQ ID NO: 8464 - protein, 7 aa, synthetic construct
  REGION 1..7: note = n-mer motif
VSSTKMA

SEQ ID NO: 8465 - protein, 7 aa, synthetic construct
  REGION 1..7: note = n-mer motif
RGDHTQW

SEQ ID NO: 8466 - protein, 7 aa, synthetic construct
  REGION 1..7: note = n-mer motif
VVRGVTD

SEQ ID NO: 8467 - protein, 7 aa, synthetic construct
  REGION 1..7: note = n-mer motif
VQVAVQR

SEQ ID NO: 8468 - protein, 7 aa, synthetic construct
  REGION 1..7: note = n-mer motif
RTVTAVE

SEQ ID NO: 8469 - protein, 7 aa, synthetic construct
  REGION 1..7: note = n-mer motif
RTQLGMA

SEQ ID NO: 8470 - protein, 7 aa, synthetic construct
  REGION 1..7: note = n-mer motif
GGSVRGS

SEQ ID NO: 8471 - protein, 7 aa, synthetic construct
  REGION 1..7: note = n-mer motif
RGDHSSL

SEQ ID NO: 8472 - protein, 7 aa, synthetic construct
  REGION 1..7: note = n-mer motif
LAGTSGA

SEQ ID NO: 8473 - protein, 7 aa, synthetic construct
  REGION 1..7: note = n-mer motif
LRTGTLS

SEQ ID NO: 8474 - protein, 7 aa, synthetic construct
  REGION 1..7: note = n-mer motif
WKAQVQA

SEQ ID NO: 8475 - protein, 7 aa, synthetic construct
  REGION 1..7: note = n-mer motif
NSTALRG

SEQ ID NO: 8476 - protein, 7 aa, synthetic construct
  REGION 1..7: note = n-mer motif
DGGRMAY

SEQ ID NO: 8477 - protein, 7 aa, synthetic construct
  REGION 1..7: note = n-mer motif
TRTPSPA

SEQ ID NO: 8478 - protein, 7 aa, synthetic construct
  REGION 1..7: note = n-mer motif
STVARGD

SEQ ID NO: 8479 - protein, 7 aa, synthetic construct
  REGION 1..7: note = n-mer motif
RAGTAMS

SEQ ID NO: 8480 - protein, 7 aa, synthetic construct
  REGION 1..7: note = n-mer motif
RGDRESH

SEQ ID NO: 8481 - protein, 7 aa, synthetic construct
  REGION 1..7: note = n-mer motif
LSRSGEL

SEQ ID NO: 8482 - protein, 7 aa, synthetic construct
  REGION 1..7: note = n-mer motif
TAGRVQV

SEQ ID NO: 8483 - protein, 7 aa, synthetic construct
  REGION 1..7: note = n-mer motif
VTTRGDV

SEQ ID NO: 8484 - protein, 7 aa, synthetic construct
  REGION 1..7: note = n-mer motif
VMRAGTS

SEQ ID NO: 8485 - protein, 7 aa, synthetic construct
  REGION 1..7: note = n-mer motif
LSRSGDL

SEQ ID NO: 8486 - protein, 7 aa, synthetic construct
  REGION 1..7: note = n-mer motif
GYGHDRS

SEQ ID NO: 8487 - protein, 7 aa, synthetic construct
  REGION 1..7: note = n-mer motif
HAYKTSP

SEQ ID NO: 8488 - protein, 7 aa, synthetic construct
  REGION 1..7: note = n-mer motif
SPGKSGG

SEQ ID NO: 8489 - protein, 7 aa, synthetic construct
  REGION 1..7: note = n-mer motif
SAGKTVV

SEQ ID NO: 8490 - protein, 7 aa, synthetic construct
  REGION 1..7: note = n-mer motif
VRGQQND

SEQ ID NO: 8491 - protein, 7 aa, synthetic construct
  REGION 1..7: note = n-mer motif
AVTRGGF

SEQ ID NO: 8492 - protein, 7 aa, synthetic construct
  REGION 1..7: note = n-mer motif
RGDLYTP

SEQ ID NO: 8493 - protein, 7 aa, synthetic construct
  REGION 1..7: note = n-mer motif
RAGTAIT

SEQ ID NO: 8494 - protein, 7 aa, synthetic construct
  REGION 1..7: note = n-mer motif
SLVRAAA

SEQ ID NO: 8495 - protein, 7 aa, synthetic construct
  REGION 1..7: note = n-mer motif
VVRGDVG

SEQ ID NO: 8496 - protein, 7 aa, synthetic construct
  REGION 1..7: note = n-mer motif
RGDLSGT

SEQ ID NO: 8497 - protein, 7 aa, synthetic construct
  REGION 1..7: note = n-mer motif
RYGATGT

SEQ ID NO: 8498 - protein, 7 aa, synthetic construct
  REGION 1..7: note = n-mer motif
PGLRGVA

SEQ ID NO: 8499 - protein, 7 aa, synthetic construct
  REGION 1..7: note = n-mer motif
IPMRGQM

SEQ ID NO: 8500 - protein, 7 aa, synthetic construct
  REGION 1..7: note = n-mer motif
SAGRSQG

SEQ ID NO: 8501 - protein, 7 aa, synthetic construct
  REGION 1..7: note = n-mer motif
VRGVGTA

SEQ ID NO: 8502 - protein, 7 aa, synthetic construct
  REGION 1..7: note = n-mer motif
RGDYVSV

SEQ ID NO: 8503 - DNA, 21 bp, synthetic construct
  misc_feature 1..21: note = n-mer motif encoding sequence
  source 1..21: mol_type = other DNA
aggggcgactaccacgccatc

SEQ ID NO: 8504 - DNA, 21 bp, synthetic construct
  misc_feature 1..21: note = n-mer motif encoding sequence
  source 1..21: mol_type = other DNA
cggggcgactacgcaagcctg

SEQ ID NO: 8505 - DNA, 21 bp, synthetic construct
  misc_feature 1..21: note = n-mer motif encoding sequence
  source 1..21: mol_type = other DNA
cggggtgattatgtggggctg

SEQ ID NO: 8506 - DNA, 21 bp, synthetic construct
  misc_feature 1..21: note = n-mer motif encoding sequence
  source 1..21: mol_type = other DNA
cgtggggatcttaggccgacg

SEQ ID NO: 8507 - DNA, 21 bp, synthetic construct
  misc_feature 1..21: note = n-mer motif encoding sequence
  source 1..21: mol_type = other DNA
cgtggggatcatgtgtctttg

SEQ ID NO: 8508 - DNA, 21 bp, synthetic construct
  misc_feature 1..21: note = n-mer motif encoding sequence
  source 1..21: mol_type = other DNA
gacgttagatcccttcacggc

SEQ ID NO: 8509 - DNA, 21 bp, synthetic construct
  misc_feature 1..21: note = n-mer motif encoding sequence
  source 1..21: mol_type = other DNA
cgtggtgattatcatgctatt

SEQ ID NO: 8510 - DNA, 21 bp, synthetic construct
  misc_feature 1..21: note = n-mer motif encoding sequence
  source 1..21: mol_type = other DNA
cgtggtgattatggtgggctg

SEQ ID NO: 8511 - DNA, 21 bp, synthetic construct
  misc_feature 1..21: note = n-mer motif encoding sequence
  source 1..21: mol_type = other DNA
cggggtgatcatggggttctt

SEQ ID NO: 8512 - DNA, 21 bp, synthetic construct
  misc_feature 1..21: note = n-mer motif encoding sequence
  source 1..21: mol_type = other DNA
agaggagactaccgggaactc

SEQ ID NO: 8513 - DNA, 21 bp, synthetic construct
  misc_feature 1..21: note = n-mer motif encoding sequence
  source 1..21: mol_type = other DNA
gttagtcggggtgatgtgcct

SEQ ID NO: 8514 - DNA, 21 bp, synthetic construct
  misc_feature 1..21: note = n-mer motif encoding sequence
  source 1..21: mol_type = other DNA
cgcggggactacgtaggttta

SEQ ID NO: 8515 - DNA, 21 bp, synthetic construct
  misc_feature 1..21: note = n-mer motif encoding sequence
  source 1..21: mol_type = other DNA
cggggtgattattcggggttg

SEQ ID NO: 8516 - DNA, 21 bp, synthetic construct
  misc_feature 1..21: note = n-mer motif encoding sequence
  source 1..21: mol_type = other DNA
aggggggacctgacagtcacg

SEQ ID NO: 8517 - DNA, 21 bp, synthetic construct
  misc_feature 1..21: note = n-mer motif encoding sequence
  source 1..21: mol_type = other DNA
cgtggtgatcatgcttcttgg

SEQ ID NO: 8518 - DNA, 21 bp, synthetic construct
  misc_feature 1..21: note = n-mer motif encoding sequence
  source 1..21: mol_type = other DNA
aggggggatcttgtggggtat

SEQ ID NO: 8519 - DNA, 21 bp, synthetic construct
  misc_feature 1..21: note = n-mer motif encoding sequence
  source 1..21: mol_type = other DNA
cgtggggatggtgcggcgatg

SEQ ID NO: 8520 - DNA, 21 bp, synthetic construct
  misc_feature 1..21: note = n-mer motif encoding sequence
  source 1..21: mol_type = other DNA
gtgagtgcggcgcgttctctg

SEQ ID NO: 8521 - DNA, 21 bp, synthetic construct
  misc_feature 1..21: note = n-mer motif encoding sequence
  source 1..21: mol_type = other DNA
ttgactgctcagtatgtgacg

SEQ ID NO: 8522 - DNA, 21 bp, synthetic construct
  misc_feature 1..21: note = n-mer motif encoding sequence
  source 1..21: mol_type = other DNA
cgcggagaccacggtgtatta

SEQ ID NO: 8523 - DNA, 21 bp, synthetic construct
  misc_feature 1..21: note = n-mer motif encoding sequence
  source 1..21: mol_type = other DNA
gttgggaataggttttcgccg

SEQ ID NO: 8524 - DNA, 21 bp, synthetic construct
  misc_feature 1..21: note = n-mer motif encoding sequence
  source 1..21: mol_type = other DNA
acgggtgttcatacgagggtg

SEQ ID NO: 8525 - DNA, 21 bp, synthetic construct
  misc_feature 1..21: note = n-mer motif encoding sequence
  source 1..21: mol_type = other DNA
gtgcgtactggtgatgcgtcg

SEQ ID NO: 8526 - DNA, 21 bp, synthetic construct
  misc_feature 1..21: note = n-mer motif encoding sequence
  source 1..21: mol_type = other DNA
atggtggtgcgtgggggtgtt

SEQ ID NO: 8527 - DNA, 21 bp, synthetic construct
  misc_feature 1..21: note = n-mer motif encoding sequence
  source 1..21: mol_type = other DNA
cgcggagaccgagaaagccac

SEQ ID NO: 8528 - DNA, 21 bp, synthetic construct
  misc_feature 1..21: note = n-mer motif encoding sequence
  source 1..21: mol_type = other DNA
cgtggcgactactctggtcta

SEQ ID NO: 8529 - DNA, 21 bp, synthetic construct
  misc_feature 1..21: note = n-mer motif encoding sequence
  source 1..21: mol_type = other DNA
cggggtgatctttcgagtgtt

SEQ ID NO: 8530 - DNA, 21 bp, synthetic construct
  misc_feature 1..21: note = n-mer motif encoding sequence
  source 1..21: mol_type = other DNA
ctgcttggtcagagggctgct

SEQ ID NO: 8531 - DNA, 21 bp, synthetic construct
  misc_feature 1..21: note = n-mer motif encoding sequence
  source 1..21: mol_type = other DNA
gggaaggggactgtgccgagt

SEQ ID NO: 8532 - DNA, 21 bp, synthetic construct
  misc_feature 1..21: note = n-mer motif encoding sequence
  source 1..21: mol_type = other DNA
tcgtcgattggtgtgaagatt

SEQ ID NO: 8533 - DNA, 21 bp, synthetic construct
  misc_feature 1..21: note = n-mer motif encoding sequence
  source 1..21: mol_type = other DNA
gcaaacaaaggcctgggcacg

SEQ ID NO: 8534 - DNA, 21 bp, synthetic construct
  misc_feature 1..21: note = n-mer motif encoding sequence
  source 1..21: mol_type = other DNA
cggggggatcatgcttcttgg

SEQ ID NO: 8535 - DNA, 21 bp, synthetic construct
  misc_feature 1..21: note = n-mer motif encoding sequence
  source 1..21: mol_type = other DNA
agaggagacaggctggtcatc

SEQ ID NO: 8536 - DNA, 21 bp, synthetic construct
  misc_feature 1..21: note = n-mer motif encoding sequence
  source 1..21: mol_type = other DNA
ggacaaggccaccggggagac

SEQ ID NO: 8537 - DNA, 21 bp, synthetic construct
  misc_feature 1..21: note = n-mer motif encoding sequence
  source 1..21: mol_type = other DNA
gagaggactcgggcgggtgag

SEQ ID NO: 8538 - DNA, 21 bp, synthetic construct
  misc_feature 1..21: note = n-mer motif encoding sequence
  source 1..21: mol_type = other DNA
aggggcgacctgtctggcacc

SEQ ID NO: 8539 - DNA, 21 bp, synthetic construct
  misc_feature 1..21: note = n-mer motif encoding sequence
  source 1..21: mol_type = other DNA
cggggggattatcgtgagatg

SEQ ID NO: 8540 - DNA, 21 bp, synthetic construct
  misc_feature 1..21: note = n-mer motif encoding sequence
  source 1..21: mol_type = other DNA
aggggtgatcttgcgcataat

SEQ ID NO: 8541 - DNA, 21 bp, synthetic construct
  misc_feature 1..21: note = n-mer motif encoding sequence
  source 1..21: mol_type = other DNA
gggtttagtgggaggacggtg

SEQ ID NO: 8542 - DNA, 21 bp, synthetic construct
  misc_feature 1..21: note = n-mer motif encoding sequence
  source 1..21: mol_type = other DNA
gttatgcgagcaggtgcgacg

SEQ ID NO: 8543 - DNA, 21 bp, synthetic construct
  misc_feature 1..21: note = n-mer motif encoding sequence
  source 1..21: mol_type = other DNA
gaaggaggaatctaccgtgtt

SEQ ID NO: 8544 - DNA, 21 bp, synthetic construct
  misc_feature 1..21: note = n-mer motif encoding sequence
  source 1..21: mol_type = other DNA
cgtggtgattatcgtgagttg

SEQ ID NO: 8545 - DNA, 21 bp, synthetic construct
  misc_feature 1..21: note = n-mer motif encoding sequence
  source 1..21: mol_type = other DNA
cagagtgtgtctattaagtct

SEQ ID NO: 8546 - DNA, 21 bp, synthetic construct
  misc_feature 1..21: note = n-mer motif encoding sequence
  source 1..21: mol_type = other DNA
cgaggagacttggtccacgtc

SEQ ID NO: 8547 - DNA, 21 bp, synthetic construct
  misc_feature 1..21: note = n-mer motif encoding sequence
  source 1..21: mol_type = other DNA
taccgtggtgacatacgggtg

SEQ ID NO: 8548 - DNA, 21 bp, synthetic construct
  misc_feature 1..21: note = n-mer motif encoding sequence
  source 1..21: mol_type = other DNA
cgtggggacgccagtacctgg

SEQ ID NO: 8549 - DNA, 21 bp, synthetic construct
  misc_feature 1..21: note = n-mer motif encoding sequence
  source 1..21: mol_type = other DNA
cgtggggattatggtggtatt

SEQ ID NO: 8550 - DNA, 21 bp, synthetic construct
  misc_feature 1..21: note = n-mer motif encoding sequence
  source 1..21: mol_type = other DNA
gtgggtacgcggggggatacg

SEQ ID NO: 8551 - DNA, 21 bp, synthetic construct
  misc_feature 1..21: note = n-mer motif encoding sequence
  source 1..21: mol_type = other DNA
cggggggatctgacgactgtt

SEQ ID NO: 8552 - DNA, 21 bp, synthetic construct
  misc_feature 1..21: note = n-mer motif encoding sequence
  source 1..21: mol_type = other DNA
cgtggtgatatgcgtccggtt

SEQ ID NO: 8553 - DNA, 21 bp, synthetic construct
  misc_feature 1..21: note = n-mer motif encoding sequence
  source 1..21: mol_type = other DNA
gctgctggtaggcttacgacg

SEQ ID NO: 8554 - DNA, 21 bp, synthetic construct
  misc_feature 1..21: note = n-mer motif encoding sequence
  source 1..21: mol_type = other DNA
aacgcagggcgctctacctta

SEQ ID NO: 8555 - DNA, 21 bp, synthetic construct
  misc_feature 1..21: note = n-mer motif encoding sequence
  source 1..21: mol_type = other DNA
gagcgggatcggatttcgggt

SEQ ID NO: 8556 - DNA, 21 bp, synthetic construct
  misc_feature 1..21: note = n-mer motif encoding sequence
  source 1..21: mol_type = other DNA
cggggtgacctgacaaccacg

SEQ ID NO: 8557 - DNA, 21 bp, synthetic construct
  misc_feature 1..21: note = n-mer motif encoding sequence
  source 1..21: mol_type = other DNA
acgactgggcttcgtctggct

SEQ ID NO: 8558 - DNA, 21 bp, synthetic construct
  misc_feature 1..21: note = n-mer motif encoding sequence
  source 1..21: mol_type = other DNA
cgtggtgatcatagtggttgg

SEQ ID NO: 8559 - DNA, 21 bp, synthetic construct
  misc_feature 1..21: note = n-mer motif encoding sequence
  source 1..21: mol_type = other DNA
agcgggggaacgtaccttgcc

SEQ ID NO: 8560 - DNA, 21 bp, synthetic construct
  misc_feature 1..21: note = n-mer motif encoding sequence
  source 1..21: mol_type = other DNA
gctgttgtgcggggtggtcct

SEQ ID NO: 8561 - DNA, 21 bp, synthetic construct
  misc_feature 1..21: note = n-mer motif encoding sequence
  source 1..21: mol_type = other DNA
attgtgaggggtctgagtgat

SEQ ID NO: 8562 - DNA, 21 bp, synthetic construct
  misc_feature 1..21: note = n-mer motif encoding sequence
  source 1..21: mol_type = other DNA
cgcggagacacgatgagactg

SEQ ID NO: 8563 - DNA, 21 bp, synthetic construct
  misc_feature 1..21: note = n-mer motif encoding sequence
  source 1..21: mol_type = other DNA
acgcgagtaccggtgagcggg

SEQ ID NO: 8564 - DNA, 21 bp, synthetic construct
  misc_feature 1..21: note = n-mer motif encoding sequence
  source 1..21: mol_type = other DNA
cgaacgtacgactcaaacgta

SEQ ID NO: 8565 - DNA, 21 bp, synthetic construct
  misc_feature 1..21: note = n-mer motif encoding sequence
  source 1..21: mol_type = other DNA
cggggtgatcgtatgggtgtg

SEQ ID NO: 8566 - DNA, 21 bp, synthetic construct
  misc_feature 1..21: note = n-mer motif encoding sequence
  source 1..21: mol_type = other DNA
cagttgaatgcgtatagtggg

SEQ ID NO: 8567 - DNA, 21 bp, synthetic construct
  misc_feature 1..21: note = n-mer motif encoding sequence
  source 1..21: mol_type = other DNA
tcattgggtataacctcgggc

SEQ ID NO: 8568 - DNA, 21 bp, synthetic construct
  misc_feature 1..21: note = n-mer motif encoding sequence
  source 1..21: mol_type = other DNA
acggctgcggtgcgtacgtat

SEQ ID NO: 8569 - DNA, 21 bp, synthetic construct
  misc_feature 1..21: note = n-mer motif encoding sequence
  source 1..21: mol_type = other DNA
cgtggggatcttactacgact

SEQ ID NO: 8570 - DNA, 21 bp, synthetic construct
  misc_feature 1..21: note = n-mer motif encoding sequence
  source 1..21: mol_type = other DNA
cggggtgattatgctactttt

SEQ ID NO: 8571 - DNA, 21 bp, synthetic construct
  misc_feature 1..21: note = n-mer motif encoding sequence
  source 1..21: mol_type = other DNA
aggggtgacatagtgggcctc

SEQ ID NO: 8572 - DNA, 21 bp, synthetic construct
  misc_feature 1..21: note = n-mer motif encoding sequence
  source 1..21: mol_type = other DNA
ggtagtcgtggcgacttatcg

SEQ ID NO: 8573 - DNA, 21 bp, synthetic construct
  misc_feature 1..21: note = n-mer motif encoding sequence
  source 1..21: mol_type = other DNA
agaggagacgttacgcacatc

SEQ ID NO: 8574 - DNA, 21 bp, synthetic construct
  misc_feature 1..21: note = n-mer motif encoding sequence
  source 1..21: mol_type = other DNA
attggtgggactcgggtgcag

SEQ ID NO: 8575 - DNA, 21 bp, synthetic construct
  misc_feature 1..21: note = n-mer motif encoding sequence
  source 1..21: mol_type = other DNA
gagaatcatactcatagggct

SEQ ID NO: 8576 - DNA, 21 bp, synthetic construct
  misc_feature 1..21: note = n-mer motif encoding sequence
  source 1..21: mol_type = other DNA
cgtggtgatctgacgtatgct

SEQ ID NO: 8577 - DNA, 21 bp, synthetic construct
  misc_feature 1..21: note = n-mer motif encoding sequence
  source 1..21: mol_type = other DNA
ttgttgcatgagtcgcgggtt

SEQ ID NO: 8578 - DNA, 21 bp, synthetic construct
  misc_feature 1..21: note = n-mer motif encoding sequence
  source 1..21: mol_type = other DNA
cgtggtgatgttagtgggatt

SEQ ID NO: 8579 - DNA, 21 bp, synthetic construct
  misc_feature 1..21: note = n-mer motif encoding sequence
  source 1..21: mol_type = other DNA
ctgaattctgcgatgcgtact

SEQ ID NO: 8580 - DNA, 21 bp, synthetic construct
  misc_feature 1..21: note = n-mer motif encoding sequence
  source 1..21: mol_type = other DNA
aggggggactacgccacactg

SEQ ID NO: 8581 - DNA, 21 bp, synthetic construct
  misc_feature 1..21: note = n-mer motif encoding sequence
  source 1..21: mol_type = other DNA
tctgcgaatgttgtgaggggg

SEQ ID NO: 8582 - DNA, 21 bp, synthetic construct
  misc_feature 1..21: note = n-mer motif encoding sequence
  source 1..21: mol_type = other DNA
gttgctgggcagcgttctgtt

SEQ ID NO: 8583 - DNA, 21 bp, synthetic construct
  misc_feature 1..21: note = n-mer motif encoding sequence
  source 1..21: mol_type = other DNA
cgtggtgatagggagcatttt

SEQ ID NO: 8584 - DNA, 21 bp, synthetic construct
  misc_feature 1..21: note = n-mer motif encoding sequence
  source 1..21: mol_type = other DNA
cgcggagactacgttacaata

SEQ ID NO: 8585 - DNA, 21 bp, synthetic construct
  misc_feature 1..21: note = n-mer motif encoding sequence
  source 1..21: mol_type = other DNA
cgtcttgtttcgactgctccg

SEQ ID NO: 8586 - DNA, 21 bp, synthetic construct
  misc_feature 1..21: note = n-mer motif encoding sequence
  source 1..21: mol_type = other DNA
caccaatcattccacggcgca

SEQ ID NO: 8587 - DNA, 21 bp, synthetic construct
  misc_feature 1..21: note = n-mer motif encoding sequence
  source 1..21: mol_type = other DNA
gtaaggggcgacagcagattc

SEQ ID NO: 8588 - DNA, 21 bp, synthetic construct
  misc_feature 1..21: note = n-mer motif encoding sequence
  source 1..21: mol_type = other DNA
aggggtgacttcggaggtgtc

SEQ ID NO: 8589 - DNA, 21 bp, synthetic construct
  misc_feature 1..21: note = n-mer motif encoding sequence
  source 1..21: mol_type = other DNA
cttgtcagaactacagtgtcc

SEQ ID NO: 8590 - DNA, 21 bp, synthetic construct
  misc_feature 1..21: note = n-mer motif encoding sequence
  source 1..21: mol_type = other DNA
cgtggggattatgtgtctgtg

SEQ ID NO: 8591 - DNA, 21 bp, synthetic construct
  misc_feature 1..21: note = n-mer motif encoding sequence
  source 1..21: mol_type = other DNA
aggggtgattatgcgtctctt

SEQ ID NO: 8592 - DNA, 21 bp, synthetic construct
  misc_feature 1..21: note = n-mer motif encoding sequence
  source 1..21: mol_type = other DNA
atcgtccgagacggaagactt

SEQ ID NO: 8593 - DNA, 21 bp, synthetic construct
  misc_feature 1..21: note = n-mer motif encoding sequence
  source 1..21: mol_type = other DNA
ctgacgcatggtatgattggt

SEQ ID NO: 8594 - DNA, 21 bp, synthetic construct
  misc_feature 1..21: note = n-mer motif encoding sequence
  source 1..21: mol_type = other DNA
cgaggcgacgttcgggtcata

SEQ ID NO: 8595 - DNA, 21 bp, synthetic construct
  misc_feature 1..21: note = n-mer motif encoding sequence
  source 1..21: mol_type = other DNA
aaggctcagccgtcttcgtct

SEQ ID NO: 8596 - DNA, 21 bp, synthetic construct
  misc_feature 1..21: note = n-mer motif encoding sequence
  source 1..21: mol_type = other DNA
gggatgaggggtgcttcggtg

SEQ ID NO: 8597 - DNA, 21 bp, synthetic construct
  misc_feature 1..21: note = n-mer motif encoding sequence
  source 1..21: mol_type = other DNA
gctgcgggtagggttgggacg

SEQ ID NO: 8598 - DNA, 21 bp, synthetic construct
  misc_feature 1..21: note = n-mer motif encoding sequence
  source 1..21: mol_type = other DNA
cagatgggtcgggttcaggtg

SEQ ID NO: 8599 - DNA, 21 bp, synthetic construct
  misc_feature 1..21: note = n-mer motif encoding sequence
  source 1..21: mol_type = other DNA
ttgatgtcgcggggtgatact

SEQ ID NO: 8600 - DNA, 21 bp, synthetic construct
  misc_feature 1..21: note = n-mer motif encoding sequence
  source 1..21: mol_type = other DNA
gtccactctcgcggagacatg

SEQ ID NO: 8601 - DNA, 21 bp, synthetic construct
  misc_feature 1..21: note = n-mer motif encoding sequence
  source 1..21: mol_type = other DNA
cggggggatctggttacggtt

SEQ ID NO: 8602 - DNA, 21 bp, synthetic construct
  misc_feature 1..21: note = n-mer motif encoding sequence
  source 1..21: mol_type = other DNA
agaaactacggcgaccactcg

SEQ ID NO: 8603 - DNA, 21 bp, synthetic construct
  misc_feature 1..21: note = n-mer motif encoding sequence
  source 1..21: mol_type = other DNA
agaggcgactacagccaaata

SEQ ID NO: 8604 - DNA, 21 bp, synthetic construct
  misc_feature 1..21: note = n-mer motif encoding sequence
  source 1..21: mol_type = other DNA
aggggtgatttggctaattct

SEQ ID NO: 8605 - DNA, 21 bp, synthetic construct
  misc_feature 1..21: note = n-mer motif encoding sequence
  source 1..21: mol_type = other DNA
cgttccagtcaccttgacgtt

SEQ ID NO: 8606 - DNA, 21 bp, synthetic construct
  misc_feature 1..21: note = n-mer motif encoding sequence
  source 1..21: mol_type = other DNA
cgctccgggaccgttggactg

SEQ ID NO: 8607 - DNA, 21 bp, synthetic construct
  misc_feature 1..21: note = n-mer motif encoding sequence
  source 1..21: mol_type = other DNA
ataggagcgaggggggacacg

SEQ ID NO: 8608 - DNA, 21 bp, synthetic construct
  misc_feature 1..21: note = n-mer motif encoding sequence
  source 1..21: mol_type = other DNA
tcgaatgcggttcctggtact

SEQ ID NO: 8609 - DNA, 21 bp, synthetic construct
  misc_feature 1..21: note = n-mer motif encoding sequence
  source 1..21: mol_type = other DNA
ttggatgctagggggcatctg

SEQ ID NO: 8610 - DNA, 21 bp, synthetic construct
  misc_feature 1..21: note = n-mer motif encoding sequence
  source 1..21: mol_type = other DNA
acttctgtgtcggtgaagtat

SEQ ID NO: 8611 - DNA, 21 bp, synthetic construct
  misc_feature 1..21: note = n-mer motif encoding sequence
  source 1..21: mol_type = other DNA
acgcgggtgatgggggcgact

SEQ ID NO: 8612 - DNA, 21 bp, synthetic construct
  misc_feature 1..21: note = n-mer motif encoding sequence
  source 1..21: mol_type = other DNA
cgaggcgggactggagtaaac

SEQ ID NO: 8613 - DNA, 21 bp, synthetic construct
  misc_feature 1..21: note = n-mer motif encoding sequence
  source 1..21: mol_type = other DNA
gtggctagtcgtacgtctgtt

SEQ ID NO: 8614 - DNA, 21 bp, synthetic construct
  misc_feature 1..21: note = n-mer motif encoding sequence
  source 1..21: mol_type = other DNA
cgtggtgatcggcttcagatt

SEQ ID NO: 8615 - DNA, 21 bp, synthetic construct
  misc_feature 1..21: note = n-mer motif encoding sequence
  source 1..21: mol_type = other DNA
cgcggtgactacgaacgacta

SEQ ID NO: 8616 - DNA, 21 bp, synthetic construct
  misc_feature 1..21: note = n-mer motif encoding sequence
  source 1..21: mol_type = other DNA
cttgcggctaaggctctggtt

SEQ ID NO: 8617 - DNA, 21 bp, synthetic construct
  misc_feature 1..21: note = n-mer motif encoding sequence
  source 1..21: mol_type = other DNA
ctggggacgacttctgcgtcg

SEQ ID NO: 8618 - DNA, 21 bp, synthetic construct
  misc_feature 1..21: note = n-mer motif encoding sequence
  source 1..21: mol_type = other DNA
cgtggggatcatgggacgatt

SEQ ID NO: 8619 - DNA, 21 bp, synthetic construct
  misc_feature 1..21: note = n-mer motif encoding sequence
  source 1..21: mol_type = other DNA
ggactccgagtagtccaagcc

SEQ ID NO: 8620 - DNA, 21 bp, synthetic construct
  misc_feature 1..21: note = n-mer motif encoding sequence
  source 1..21: mol_type = other DNA
cgtcagactgtggggatgggt

SEQ ID NO: 8621 - DNA, 21 bp, synthetic construct
  misc_feature 1..21: note = n-mer motif encoding sequence
  source 1..21: mol_type = other DNA
aggggggatctgttgacgaat

SEQ ID NO: 8622 - DNA, 21 bp, synthetic construct
  misc_feature 1..21: note = n-mer motif encoding sequence
  source 1..21: mol_type = other DNA
tacggacacggcatggtcggg

SEQ ID NO: 8623 - DNA, 21 bp, synthetic construct
  misc_feature 1..21: note = n-mer motif encoding sequence
  source 1..21: mol_type = other DNA
gttgttgctgctcttcggggt

SEQ ID NO: 8624 - DNA, 21 bp, synthetic construct
  misc_feature 1..21: note = n-mer motif encoding sequence
  source 1..21: mol_type = other DNA
cagttgtcgaggagtggtacg

SEQ ID NO: 8625 - DNA, 21 bp, synthetic construct
  misc_feature 1..21: note = n-mer motif encoding sequence
  source 1..21: mol_type = other DNA
ggtctttcgaggacgggggtg

SEQ ID NO: 8626 - DNA, 21 bp, synthetic construct
  misc_feature 1..21: note = n-mer motif encoding sequence
  source 1..21: mol_type = other DNA
atgggtggtggtcgtcttact

SEQ ID NO: 8627 - DNA, 21 bp, synthetic construct
  misc_feature 1..21: note = n-mer motif encoding sequence
  source 1..21: mol_type = other DNA
agaggcgacttagtgatggtg

SEQ ID NO: 8628 - DNA, 21 bp, synthetic construct
  misc_feature 1..21: note = n-mer motif encoding sequence
  source 1..21: mol_type = other DNA
aggggtgacgtcgtaggcctg

SEQ ID NO: 8629 - DNA, 21 bp, synthetic construct
  misc_feature 1..21: note = n-mer motif encoding sequence
  source 1..21: mol_type = other DNA
gtgacgaaggttggggtgctg

SEQ ID NO: 8630 - DNA, 21 bp, synthetic construct
  misc_feature 1..21: note = n-mer motif encoding sequence
  source 1..21: mol_type = other DNA
cgcacctcataccctgaagcc

SEQ ID NO: 8631 - DNA, 21 bp, synthetic construct
  misc_feature 1..21: note = n-mer motif encoding sequence
  source 1..21: mol_type = other DNA
gaatcgcgggcaacgatgtct

SEQ ID NO: 8632 - DNA, 21 bp, synthetic construct
  misc_feature 1..21: note = n-mer motif encoding sequence
  source 1..21: mol_type = other DNA
agtcgggtgggtgttggtgcg

SEQ ID NO: 8633 - DNA, 21 bp, synthetic construct
  misc_feature 1..21: note = n-mer motif encoding sequence
  source 1..21: mol_type = other DNA
cgaggcgactacgtgactatg

SEQ ID NO: 8634 - DNA, 21 bp, synthetic construct
  misc_feature 1..21: note = n-mer motif encoding sequence
  source 1..21: mol_type = other DNA
agggctcagggtcctcaggcg

SEQ ID NO: 8635 - DNA, 21 bp, synthetic construct
  misc_feature 1..21: note = n-mer motif encoding sequence
  source 1..21: mol_type = other DNA
gtcacatcccacgccatggcc

SEQ ID NO: 8636 - DNA, 21 bp, synthetic construct
  misc_feature 1..21: note = n-mer motif encoding sequence
  source 1..21: mol_type = other DNA
cgaggggacttaggcggcgtc

SEQ ID NO: 8637 - DNA, 21 bp, synthetic construct
  misc_feature 1..21: note = n-mer motif encoding sequence
  source 1..21: mol_type = other DNA
agtattcgtggtgagctgggt

SEQ ID NO: 8638 - DNA, 21 bp, synthetic construct
  misc_feature 1..21: note = n-mer motif encoding sequence
  source 1..21: mol_type = other DNA
cgtggtgatgggagtgctctt

SEQ ID NO: 8639 - DNA, 21 bp, synthetic construct
  misc_feature 1..21: note = n-mer motif encoding sequence
  source 1..21: mol_type = other DNA
tctaggagtggtattgcgatt

SEQ ID NO: 8640 - DNA, 21 bp, synthetic construct
  misc_feature 1..21: note = n-mer motif encoding sequence
  source 1..21: mol_type = other DNA
caggcggggacgcttgggtat

SEQ ID NO: 8641 - DNA, 21 bp, synthetic construct
  misc_feature 1..21: note = n-mer motif encoding sequence
  source 1..21: mol_type = other DNA
aggggtgatcttacgactgcg

SEQ ID NO: 8642 - DNA, 21 bp, synthetic construct
  misc_feature 1..21: note = n-mer motif encoding sequence
  source 1..21: mol_type = other DNA
cttggtcatcggggtgatgtt

SEQ ID NO: 8643 - DNA, 21 bp, synthetic construct
  misc_feature 1..21: note = n-mer motif encoding sequence
  source 1..21: mol_type = other DNA
agaggcgacctgaccatcaca

SEQ ID NO: 8644 - DNA, 21 bp, synthetic construct
  misc_feature 1..21: note = n-mer motif encoding sequence
  source 1..21: mol_type = other DNA
cgtggggatcttcgggtgcct

SEQ ID NO: 8645 - DNA, 21 bp, synthetic construct
  misc_feature 1..21: note = n-mer motif encoding sequence
  source 1..21: mol_type = other DNA
aactcggaccaccgcatactc

SEQ ID NO: 8646 - DNA, 21 bp, synthetic construct
  misc_feature 1..21: note = n-mer motif encoding sequence
  source 1..21: mol_type = other DNA
cgtggagactaccactcattc

SEQ ID NO: 8647 - DNA, 21 bp, synthetic construct
  misc_feature 1..21: note = n-mer motif encoding sequence
  source 1..21: mol_type = other DNA
gggacaggtcgatacgtgagc

SEQ ID NO: 8648 - DNA, 21 bp, synthetic construct
  misc_feature 1..21: note = n-mer motif encoding sequence
  source 1..21: mol_type = other DNA
ccgttgttgaggagtgggacg

SEQ ID NO: 8649 - DNA, 21 bp, synthetic construct
  misc_feature 1..21: note = n-mer motif encoding sequence
  source 1..21: mol_type = other DNA
cgtggagacgtcgtaagttgg

SEQ ID NO: 8650 - DNA, 21 bp, synthetic construct
  misc_feature 1..21: note = n-mer motif encoding sequence
  source 1..21: mol_type = other DNA
gtgatgcgtgtggggcatgct

SEQ ID NO: 8651 - DNA, 21 bp, synthetic construct
  misc_feature 1..21: note = n-mer motif encoding sequence
  source 1..21: mol_type = other DNA
aggggggatctggtgtctgtt

SEQ ID NO: 8652 - DNA, 21 bp, synthetic construct
  misc_feature 1..21: note = n-mer motif encoding sequence
  source 1..21: mol_type = other DNA
cggggtgatttgacgggggtg

SEQ ID NO: 8653 - DNA, 21 bp, synthetic construct
  misc_feature 1..21: note = n-mer motif encoding sequence
  source 1..21: mol_type = other DNA
gtgtcgtctacgaagatggct

SEQ ID NO: 8654 - DNA, 21 bp, synthetic construct
  misc_feature 1..21: note = n-mer motif encoding sequence
  source 1..21: mol_type = other DNA
cgcggagaccacacgcaatgg

SEQ ID NO: 8655 - DNA, 21 bp, synthetic construct
  misc_feature 1..21: note = n-mer motif encoding sequence
  source 1..21: mol_type = other DNA
gtagttagaggtgtgaccgac

SEQ ID NO: 8656 - DNA, 21 bp, synthetic construct
  misc_feature 1..21: note = n-mer motif encoding sequence
  source 1..21: mol_type = other DNA
gttcaggttgcggtgcagagg

SEQ ID NO: 8657 - DNA, 21 bp, synthetic construct
  misc_feature 1..21: note = n-mer motif encoding sequence
  source 1..21: mol_type = other DNA
cgtactgtgacggcggtggag

SEQ ID NO: 8658 - DNA, 21 bp, synthetic construct
  misc_feature 1..21: note = n-mer motif encoding sequence
  source 1..21: mol_type = other DNA
cgaactcaattaggaatggcg

SEQ ID NO: 8659 - DNA, 21 bp, synthetic construct
  misc_feature 1..21: note = n-mer motif encoding sequence
  source 1..21: mol_type = other DNA
gggggttcggtgaggggttcg

SEQ ID NO: 8660 - DNA, 21 bp, synthetic construct
  misc_feature 1..21: note = n-mer motif encoding sequence
  source 1..21: mol_type = other DNA
aggggggatcattctagtctg

SEQ ID NO: 8661 - DNA, 21 bp, synthetic construct
  misc_feature 1..21: note = n-mer motif encoding sequence
  source 1..21: mol_type = other DNA
cttgctgggactagtggggcg

SEQ ID NO: 8662 - DNA, 21 bp, synthetic construct
  misc_feature 1..21: note = n-mer motif encoding sequence
  source 1..21: mol_type = other DNA
cttaggactgggactttgagt

SEQ ID NO: 8663 - DNA, 21 bp, synthetic construct
  misc_feature 1..21: note = n-mer motif encoding sequence
  source 1..21: mol_type = other DNA
tggaaagcccaagttcaagct

SEQ ID NO: 8664 - DNA, 21 bp, synthetic construct
  misc_feature 1..21: note = n-mer motif encoding sequence
  source 1..21: mol_type = other DNA
aattctacggctcttcgtggg

SEQ ID NO: 8665 - DNA, 21 bp, synthetic construct
  misc_feature 1..21: note = n-mer motif encoding sequence
  source 1..21: mol_type = other DNA
gacggtgggcgaatggcttac

SEQ ID NO: 8666 - DNA, 21 bp, synthetic construct
  misc_feature 1..21: note = n-mer motif encoding sequence
  source 1..21: mol_type = other DNA
acaagaacaccttctcccgct

SEQ ID NO: 8667 - DNA, 21 bp, synthetic construct
  misc_feature 1..21: note = n-mer motif encoding sequence
  source 1..21: mol_type = other DNA
tcaacggtcgcaaggggggac

SEQ ID NO: 8668 - DNA, 21 bp, synthetic construct
  misc_feature 1..21: note = n-mer motif encoding sequence
  source 1..21: mol_type = other DNA
agggctggcacggccatgagt

SEQ ID NO: 8669 - DNA, 21 bp, synthetic construct
  misc_feature 1..21: note = n-mer motif encoding sequence
  source 1..21: mol_type = other DNA
aggggggatcgtgagagtcat

SEQ ID NO: 8670 - DNA, 21 bp, synthetic construct
  misc_feature 1..21: note = n-mer motif encoding sequence
  source 1..21: mol_type = other DNA
ctgagtcggagtggtgagctg

SEQ ID NO: 8671 - DNA, 21 bp, synthetic construct
  misc_feature 1..21: note = n-mer motif encoding sequence
  source 1..21: mol_type = other DNA
actgctgggcgtgttcaggtg

SEQ ID NO: 8672 - DNA, 21 bp, synthetic construct
  misc_feature 1..21: note = n-mer motif encoding sequence
  source 1..21: mol_type = other DNA
gtgacgactcgtggtgatgtg

SEQ ID NO: 8673 - DNA, 21 bp, synthetic construct
  misc_feature 1..21: note = n-mer motif encoding sequence
  source 1..21: mol_type = other DNA
gttatgcgtgcggggactagt

SEQ ID NO: 8674 - DNA, 21 bp, synthetic construct
  misc_feature 1..21: note = n-mer motif encoding sequence
  source 1..21: mol_type = other DNA
ttgtctcggagtggtgatctt

SEQ ID NO: 8675 - DNA, 21 bp, synthetic construct
  misc_feature 1..21: note = n-mer motif encoding sequence
  source 1..21: mol_type = other DNA
ggttatggtcatgatcggagt

SEQ ID NO: 8676 - DNA, 21 bp, synthetic construct
  misc_feature 1..21: note = n-mer motif encoding sequence
  source 1..21: mol_type = other DNA
catgcttataagacgtctcct

SEQ ID NO: 8677 - DNA, 21 bp, synthetic construct
  misc_feature 1..21: note = n-mer motif encoding sequence
  source 1..21: mol_type = other DNA
agtccgggtaagtctgggggt

SEQ ID NO: 8678 - DNA, 21 bp, synthetic construct
  misc_feature 1..21: note = n-mer motif encoding sequence
  source 1..21: mol_type = other DNA
tcggcggggaagacggttgtt

SEQ ID NO: 8679 - DNA, 21 bp, synthetic construct
  misc_feature 1..21: note = n-mer motif encoding sequence
  source 1..21: mol_type = other DNA
gtgagggggcagcagaatgat

SEQ ID NO: 8680 - DNA, 21 bp, synthetic construct
  misc_feature 1..21: note = n-mer motif encoding sequence
  source 1..21: mol_type = other DNA
gctgtgactaggggtggtttt

SEQ ID NO: 8681 - DNA, 21 bp, synthetic construct
  misc_feature 1..21: note = n-mer motif encoding sequence
  source 1..21: mol_type = other DNA
aggggtgatctttatacgccg

SEQ ID NO: 8682 - DNA, 21 bp, synthetic construct
  misc_feature 1..21: note = n-mer motif encoding sequence
  source 1..21: mol_type = other DNA
cgtgcgggtactgctattact

SEQ ID NO: 8683 - DNA, 21 bp, synthetic construct
  misc_feature 1..21: note = n-mer motif encoding sequence
  source 1..21: mol_type = other DNA
tcgttggttcgtgctgctgct

SEQ ID NO: 8684 - DNA, 21 bp, synthetic construct
  misc_feature 1..21: note = n-mer motif encoding sequence
  source 1..21: mol_type = other DNA
gtcgtccgaggcgacgtcggc

SEQ ID NO: 8685 - DNA, 21 bp, synthetic construct
  misc_feature 1..21: note = n-mer motif encoding sequence
  source 1..21: mol_type = other DNA
cgtggtgatctttcgggtacg

SEQ ID NO: 8686 - DNA, 21 bp, synthetic construct
  misc_feature 1..21: note = n-mer motif encoding sequence
  source 1..21: mol_type = other DNA
aggtatggtgctacggggact

SEQ ID NO: 8687 - DNA, 21 bp, synthetic construct
  misc_feature 1..21: note = n-mer motif encoding sequence
  source 1..21: mol_type = other DNA
cctggtctgaggggggttgcg

SEQ ID NO: 8688 - DNA, 21 bp, synthetic construct
  misc_feature 1..21: note = n-mer motif encoding sequence
  source 1..21: mol_type = other DNA
attccgatgaggggtcagatg

SEQ ID NO: 8689 - DNA, 21 bp, synthetic construct
  misc_feature 1..21: note = n-mer motif encoding sequence
  source 1..21: mol_type = other DNA
agtgctggtcgtagtcagggg

SEQ ID NO: 8690 - DNA, 21 bp, synthetic construct
  misc_feature 1..21: note = n-mer motif encoding sequence
  source 1..21: mol_type = other DNA
gttcggggggttggtacggct

SEQ ID NO: 8691 - DNA, 21 bp, synthetic construct
  misc_feature 1..21: note = n-mer motif encoding sequence
  source 1..21: mol_type = other DNA
cggggagactacgtcagtgtc

SEQ ID NO: 8692 - protein, 7 aa, synthetic construct
  REGION 1..7: note = n-mer motif
RGDYVGL

SEQ ID NO: 8693 - protein, 7 aa, synthetic construct
  REGION 1..7: note = n-mer motif
RGDYSSV

SEQ ID NO: 8694 - protein, 7 aa, synthetic construct
  REGION 1..7: note = n-mer motif
RGDYSGL

SEQ ID NO: 8695 - protein, 7 aa, synthetic construct
  REGION 1..7: note = n-mer motif
RGDHERL

SEQ ID NO: 8696 - protein, 7 aa, synthetic construct
  REGION 1..7: note = n-mer motif
RGDLTVT

SEQ ID NO: 8697 - protein, 7 aa, synthetic construct
  REGION 1..7: note = n-mer motif
RGDYHAI

SEQ ID NO: 8698 - protein, 7 aa, synthetic construct
  REGION 1..7: note = n-mer motif
RGDYREL

SEQ ID NO: 8699 - protein, 7 aa, synthetic construct
  REGION 1..7: note = n-mer motif
RGDHGVL

SEQ ID NO: 8700 - protein, 7 aa, synthetic construct
  REGION 1..7: note = n-mer motif
RGDHASW

SEQ ID NO: 8701 - protein, 7 aa, synthetic construct
  REGION 1..7: note = n-mer motif
RGDYSGL

SEQ ID NO: 8702 - protein, 7 aa, synthetic construct
  REGION 1..7: note = n-mer motif
RGDAMHL

SEQ ID NO: 8703 - protein, 7 aa, synthetic construct
  REGION 1..7: note = n-mer motif
RGDHVSL

SEQ ID NO: 8704 - protein, 7 aa, synthetic construct
  REGION 1..7: note = n-mer motif
RGDHGQL

SEQ ID NO: 8705 - protein, 7 aa, synthetic construct
  REGION 1..7: note = n-mer motif
RGDYGGL

SEQ ID NO: 8706 - protein, 7 aa, synthetic construct
  REGION 1..7: note = n-mer motif
RGDYVTM

SEQ ID NO: 8707 - protein, 7 aa, synthetic construct
  REGION 1..7: note = n-mer motif
RGDHSTW

SEQ ID NO: 8708 - protein, 7 aa, synthetic construct
  REGION 1..7: note = n-mer motif
RGDLSGT

SEQ ID NO: 8709 - protein, 7 aa, synthetic construct
  REGION 1..7: note = n-mer motif
RGDYREM

SEQ ID NO: 8710 - protein, 7 aa, synthetic construct
  REGION 1..7: note = n-mer motif
RGDTERL

SEQ ID NO: 8711 - protein, 7 aa, synthetic construct
  REGION 1..7: note = n-mer motif
RGDHSTW

SEQ ID NO: 8712 - protein, 7 aa, synthetic construct
  REGION 1..7: note = n-mer motif
RGDLSGT

SEQ ID NO: 8713 - protein, 7 aa, synthetic construct
  REGION 1..7: note = n-mer motif
RGDHASW

SEQ ID NO: 8714 - protein, 7 aa, synthetic construct
  REGION 1..7: note = n-mer motif
RGDLSSV

SEQ ID NO: 8715 - protein, 7 aa, synthetic construct
  REGION 1..7: note = n-mer motif
RGDTVVL

SEQ ID NO: 8716 - protein, 7 aa, synthetic construct
  REGION 1..7: note = n-mer motif
RGDAAGL

SEQ ID NO: 8717 - protein, 7 aa, synthetic construct
  REGION 1..7: note = n-mer motif
RGDGATL

SEQ ID NO: 8718 - protein, 7 aa, synthetic construct
  REGION 1..7: note = n-mer motif
RGDYASL

SEQ ID NO: 8719 - protein, 7 aa, synthetic construct
  REGION 1..7: note = n-mer motif
MTARNPM

SEQ ID NO: 8720 - protein, 7 aa, synthetic construct
  REGION 1..7: note = n-mer motif
YVVGSRS

SEQ ID NO: 8721 - protein, 7 aa, synthetic construct
  REGION 1..7: note = n-mer motif
YAVGSRS

SEQ ID NO: 8722 - protein, 7 aa, synthetic construct
  REGION 1..7: note = n-mer motif
RGDYVGL

SEQ ID NO: 8723 - protein, 7 aa, synthetic construct
  REGION 1..7: note = n-mer motif
RGDLTTT

SEQ ID NO: 8724 - protein, 7 aa, synthetic construct
  REGION 1..7: note = n-mer motif
RGDYERL

SEQ ID NO: 8725 - protein, 7 aa, synthetic construct
  REGION 1..7: note = n-mer motif
RGDYREL

SEQ ID NO: 8726 - protein, 7 aa, synthetic construct
  REGION 1..7: note = n-mer motif
RGDHGVL

SEQ ID NO: 8727 - protein, 7 aa, synthetic construct
  REGION 1..7: note = n-mer motif
RGDYHAI

SEQ ID NO: 8728 - protein, 7 aa, synthetic construct
  REGION 1..7: note = n-mer motif
RGDHTQW

SEQ ID NO: 8729 - protein, 7 aa, synthetic construct
  REGION 1..7: note = n-mer motif
RGDLLGT

SEQ ID NO: 8730 - protein, 7 aa, synthetic construct
  REGION 1..7: note = n-mer motif
RGDLTGV

SEQ ID NO: 8731 - protein, 7 aa, synthetic construct
  REGION 1..7: note = n-mer motif
RGDSYTL

SEQ ID NO: 8732 - protein, 7 aa, synthetic construct
  REGION 1..7: note = n-mer motif
RGDYGTV

SEQ ID NO: 8733 - protein, 7 aa, synthetic construct
  REGION 1..7: note = n-mer motif
RGDVVGL

SEQ ID NO: 8734 - protein, 7 aa, synthetic construct
  REGION 1..7: note = n-mer motif
RGDTERL

SEQ ID NO: 8735 - protein, 7 aa, synthetic construct
  REGION 1..7: note = n-mer motif
RGDHSSL

SEQ ID NO: 8736 - protein, 7 aa, synthetic construct
  REGION 1..7: note = n-mer motif
RGDHGQL

SEQ ID NO: 8737 - protein, 7 aa, synthetic construct
  REGION 1..7: note = n-mer motif
RGDVTGM

SEQ ID NO: 8738 - protein, 7 aa, synthetic construct
  REGION 1..7: note = n-mer motif
RGDYGGL

SEQ ID NO: 8739 - protein, 7 aa, synthetic construct
  REGION 1..7: note = n-mer motif
RGDYAGH

SEQ ID NO: 8740 - protein, 7 aa, synthetic construct
  REGION 1..7: note = n-mer motif
RGDIVGL

SEQ ID NO: 8741 - protein, 7 aa, synthetic construct
  REGION 1..7: note = n-mer motif
RGDLVGY

SEQ ID NO: 8742 - protein, 7 aa, synthetic construct
  REGION 1..7: note = n-mer motif
RGDGAHL

SEQ ID NO: 8743 - protein, 7 aa, synthetic construct
  REGION 1..7: note = n-mer motif
RGDQVVV

SEQ ID NO: 8744 - protein, 7 aa, synthetic construct
  REGION 1..7: note = n-mer motif
RGDTMGM

SEQ ID NO: 8745 - protein, 7 aa, synthetic construct
  REGION 1..7: note = n-mer motif
RGDLLGT

SEQ ID NO: 8746 - protein, 7 aa, synthetic construct
  REGION 1..7: note = n-mer motif
RGDLSGN

SEQ ID NO: 8747 - protein, 7 aa, synthetic construct
  REGION 1..7: note = n-mer motif
FNVSTRT

SEQ ID NO: 8748 - protein, 7 aa, synthetic construct
  REGION 1..7: note = n-mer motif
RGDRTVI

SEQ ID NO: 8749 - protein, 7 aa, synthetic construct
  REGION 1..7: note = n-mer motif
RGDVSGI

SEQ ID NO: 8750 - protein, 7 aa, synthetic construct
  REGION 1..7: note = n-mer motif
RGDYASL

SEQ ID NO: 8751 - protein, 7 aa, synthetic construct
  REGION 1..7: note = n-mer motif
RGDQALI

SEQ ID NO: 8752 - protein, 7 aa, synthetic construct
  REGION 1..7: note = n-mer motif
RGDRDSW

SEQ ID NO: 8753 - protein, 7 aa, synthetic construct
  REGION 1..7: note = n-mer motif
RGDREGL

SEQ ID NO: 8754 - protein, 7 aa, synthetic construct
  REGION 1..7: note = n-mer motif
RGDYVSV

SEQ ID NO: 8755 - protein, 7 aa, synthetic construct
  REGION 1..7: note = n-mer motif
RGDTMRL

SEQ ID NO: 8756 - protein, 7 aa, synthetic construct
  REGION 1..7: note = n-mer motif
RGDYAHT

SEQ ID NO: 8757 - protein, 7 aa, synthetic construct
  REGION 1..7: note = n-mer motif
RGDTEKL

SEQ ID NO: 8758 - protein, 7 aa, synthetic construct
  REGION 1..7: note = n-mer motif
RGDQWQV

SEQ ID NO: 8759 - protein, 7 aa, synthetic construct
  REGION 1..7: note = n-mer motif
RGDILNV

SEQ ID NO: 8760 - protein, 7 aa, synthetic construct
  REGION 1..7: note = n-mer motif
RGDREQV

SEQ ID NO: 8761 - protein, 7 aa, synthetic construct
  REGION 1..7: note = n-mer motif
RGDNWQM

SEQ ID NO: 8762 - protein, 7 aa, synthetic construct
  REGION 1..7: note = n-mer motif
RGDYGGM

SEQ ID NO: 8763 - protein, 7 aa, synthetic construct
  REGION 1..7: note = n-mer motif
RGDLDGR

SEQ ID NO: 8764 - protein, 7 aa, synthetic construct
  REGION 1..7: note = n-mer motif
RGDHERL

SEQ ID NO: 8765 - protein, 7 aa, synthetic construct
  REGION 1..7: note = n-mer motif
RGDLGVV

SEQ ID NO: 8766 - protein, 7 aa, synthetic construct
  REGION 1..7: note = n-mer motif
RGDRESH

SEQ ID NO: 8767 - protein, 7 aa, synthetic construct
  REGION 1..7: note = n-mer motif
RGDAATM

SEQ ID NO: 8768 - protein, 7 aa, synthetic construct
  REGION 1..7: note = n-mer motif
RGDLGGV

SEQ ID NO: 8769 - protein, 7 aa, synthetic construct
  REGION 1..7: note = n-mer motif
RGDAGQL

SEQ ID NO: 8770 - protein, 7 aa, synthetic construct
  REGION 1..7: note = n-mer motif
RGDRGEI

SEQ ID NO: 8771 - protein, 7 aa, synthetic construct
  REGION 1..7: note = n-mer motif
RGDVVSW

SEQ ID NO: 8772 - protein, 7 aa, synthetic construct
  REGION 1..7: note = n-mer motif
MTARSPM

SEQ ID NO: 8773 - protein, 7 aa, synthetic construct
  REGION 1..7: note = n-mer motif
TIRDGRL

SEQ ID NO: 8774 - protein, 7 aa, synthetic construct
  REGION 1..7: note = n-mer motif
RGDIVGL

SEQ ID NO: 8775 - protein, 7 aa, synthetic construct
  REGION 1..7: note = n-mer motif
RGDYQAV

SEQ ID NO: 8776 - protein, 7 aa, synthetic construct
  REGION 1..7: note = n-mer motif
RGDGAHM

SEQ ID NO: 8777 - protein, 7 aa, synthetic construct
  REGION 1..7: note = n-mer motif
RGDAASI

SEQ ID NO: 8778 - protein, 7 aa, synthetic construct
  REGION 1..7: note = n-mer motif
RGDNSQW

SEQ ID NO: 8779 - protein, 7 aa, synthetic construct
  REGION 1..7: note = n-mer motif
RGDHSGL

SEQ ID NO: 8780 - protein, 7 aa, synthetic construct
  REGION 1..7: note = n-mer motif
RGDMGGT

SEQ ID NO: 8781 - protein, 7 aa, synthetic construct
  REGION 1..7: note = n-mer motif
RGDLTGV

SEQ ID NO: 8782 - protein, 7 aa, synthetic construct
  REGION 1..7: note = n-mer motif
RGDVSGY

SEQ ID NO: 8783 - protein, 7 aa, synthetic construct
  REGION 1..7: note = n-mer motif
RGDLTTT

SEQ ID NO: 8784 - protein, 7 aa, synthetic construct
  REGION 1..7: note = n-mer motif
RGDYGTV

SEQ ID NO: 8785 - protein, 7 aa, synthetic construct
  REGION 1..7: note = n-mer motif
RGDTMGM

SEQ ID NO: 8786 - protein, 7 aa, synthetic construct
  REGION 1..7: note = n-mer motif
RGDYSSV

SEQ ID NO: 8787 - protein, 7 aa, synthetic construct
  REGION 1..7: note = n-mer motif
RGDYGGM

SEQ ID NO: 8788 - protein, 7 aa, synthetic construct
  REGION 1..7: note = n-mer motif
RGDYVSV

SEQ ID NO: 8789 - protein, 7 aa, synthetic construct
  REGION 1..7: note = n-mer motif
RGDVTGL

SEQ ID NO: 8790 - protein, 7 aa, synthetic construct
  REGION 1..7: note = n-mer motif
RGDLLTN

SEQ ID NO: 8791 - protein, 7 aa, synthetic construct
  REGION 1..7: note = n-mer motif
RGDHSGW

SEQ ID NO: 8792 - protein, 7 aa, synthetic construct
  REGION 1..7: note = n-mer motif
VSRGDVP

SEQ ID NO: 8793 - protein, 7 aa, synthetic construct
  REGION 1..7: note = n-mer motif
RGDVSGM

SEQ ID NO: 8794 - protein, 7 aa, synthetic construct
  REGION 1..7: note = n-mer motif
RGDRVGM

SEQ ID NO: 8795 - protein, 7 aa, synthetic construct
  REGION 1..7: note = n-mer motif
RGDGGVL

SEQ ID NO: 8796 - protein, 7 aa, synthetic construct
  REGION 1..7: note = n-mer motif
RGDYVTI

SEQ ID NO: 8797 - protein, 7 aa, synthetic construct
  REGION 1..7: note = n-mer motif
RGDIAGV

SEQ ID NO: 8798 - protein, 7 aa, synthetic construct
  REGION 1..7: note = n-mer motif
RGDREQV

SEQ ID NO: 8799 - protein, 7 aa, synthetic construct
  REGION 1..7: note = n-mer motif
RGDLDNK

SEQ ID NO: 8800 - protein, 7 aa, synthetic construct
  REGION 1..7: note = n-mer motif
RGDLTSV

SEQ ID NO: 8801 - protein, 7 aa, synthetic construct
  REGION 1..7: note = n-mer motif
FNVSVRN

SEQ ID NO: 8802 - protein, 7 aa, synthetic construct
  REGION 1..7: note = n-mer motif
RGDLVHT

SEQ ID NO: 8803 - protein, 7 aa, synthetic construct
  REGION 1..7: note = n-mer motif
RGDHGVI

SEQ ID NO: 8804 - protein, 7 aa, synthetic construct
  REGION 1..7: note = n-mer motif
RGDAREM

SEQ ID NO: 8805 - protein, 7 aa, synthetic construct
  REGION 1..7: note = n-mer motif
RGDQASY

SEQ ID NO: 8806 - protein, 7 aa, synthetic construct
  REGION 1..7: note = n-mer motif
RGDHSSL

SEQ ID NO: 8807 - protein, 7 aa, synthetic construct
  REGION 1..7: note = n-mer motif
RGDVRVI

SEQ ID NO: 8808 - protein, 7 aa, synthetic construct
  REGION 1..7: note = n-mer motif
TVGRGDT

SEQ ID NO: 8809 - protein, 7 aa, synthetic construct
  REGION 1..7: note = n-mer motif
RGDHGSL

SEQ ID NO: 8810 - protein, 7 aa, synthetic construct
  REGION 1..7: note = n-mer motif
RGDFERT

SEQ ID NO: 8811 - protein, 7 aa, synthetic construct
  REGION 1..7: note = n-mer motif
RGDHSGL

SEQ ID NO: 8812 - protein, 7 aa, synthetic construct
  REGION 1..7: note = n-mer motif
RGDMSTV

SEQ ID NO: 8813 - protein, 7 aa, synthetic construct
  REGION 1..7: note = n-mer motif
RGDYATL

SEQ ID NO: 8814 - protein, 7 aa, synthetic construct
  REGION 1..7: note = n-mer motif
LPGVGHA

SEQ ID NO: 8815 - protein, 7 aa, synthetic construct
  REGION 1..7: note = n-mer motif
RGDALHL

SEQ ID NO: 8816 - protein, 7 aa, synthetic construct
  REGION 1..7: note = n-mer motif
SGGTYLA

SEQ ID NO: 8817 - protein, 7 aa, synthetic construct
  REGION 1..7: note = n-mer motif
RGDVVHL

SEQ ID NO: 8818 - protein, 7 aa, synthetic construct
  REGION 1..7: note = n-mer motif
RGDQVQL

SEQ ID NO: 8819 - protein, 7 aa, synthetic construct
  REGION 1..7: note = n-mer motif
SSIGVKI

SEQ ID NO: 8820 - protein, 7 aa, synthetic construct
  REGION 1..7: note = n-mer motif
RGDHMSL

SEQ ID NO: 8821 - protein, 7 aa, synthetic construct
  REGION 1..7: note = n-mer motif
RGDMSTV

SEQ ID NO: 8822 - protein, 7 aa, synthetic construct
  REGION 1..7: note = n-mer motif
VMRAGAT

SEQ ID NO: 8823 - protein, 7 aa, synthetic construct
  REGION 1..7: note = n-mer motif
RGDVVGL

SEQ ID NO: 8824 - protein, 7 aa, synthetic construct
  REGION 1..7: note = n-mer motif
RGDTVVL

SEQ ID NO: 8825 - protein, 7 aa, synthetic construct
  REGION 1..7: note = n-mer motif
GTKVGVL

SEQ ID NO: 8826 - protein, 7 aa, synthetic construct
  REGION 1..7: note = n-mer motif
TGVHTRV

SEQ ID NO: 8827 - protein, 7 aa, synthetic construct
  REGION 1..7: note = n-mer motif
RGDAGVL

SEQ ID NO: 8828 - protein, 7 aa, synthetic construct
  REGION 1..7: note = n-mer motif
RGDLSTT

SEQ ID NO: 8829 - protein, 7 aa, synthetic construct
  REGION 1..7: note = n-mer motif
RGDRLQI

SEQ ID NO: 8830 - protein, 7 aa, synthetic construct
  REGION 1..7: note = n-mer motif
RGDAVTL

SEQ ID NO: 8831 - protein, 7 aa, synthetic construct
  REGION 1..7: note = n-mer motif
RGDMVSV

SEQ ID NO: 8832 - protein, 7 aa, synthetic construct
  REGION 1..7: note = n-mer motif
RGDRENL

SEQ ID NO: 8833 - protein, 7 aa, synthetic construct
  REGION 1..7: note = n-mer motif
RGDGAAM

SEQ ID NO: 8834 - protein, 7 aa, synthetic construct
  REGION 1..7: note = n-mer motif
RGDLTRT

SEQ ID NO: 8835 - protein, 7 aa, synthetic construct
  REGION 1..7: note = n-mer motif
RGDYGGI

SEQ ID NO: 8836 - protein, 7 aa, synthetic construct
  REGION 1..7: note = n-mer motif
RGDMEPR

SEQ ID NO: 8837 - protein, 7 aa, synthetic construct
  REGION 1..7: note = n-mer motif
RGDTAVQ

SEQ ID NO: 8838 - protein, 7 aa, synthetic construct
  REGION 1..7: note = n-mer motif
AVTRGGV

SEQ ID NO: 8839 - protein, 7 aa, synthetic construct
  REGION 1..7: note = n-mer motif
VSAARSL

SEQ ID NO: 8840 - protein, 7 aa, synthetic construct
  REGION 1..7: note = n-mer motif
GRLPQQT

SEQ ID NO: 8841 - protein, 7 aa, synthetic construct
  REGION 1..7: note = n-mer motif
RGDLVGY

SEQ ID NO: 8842 - protein, 7 aa, synthetic construct
  REGION 1..7: note = n-mer motif
RGDLVTV

SEQ ID NO: 8843 - protein, 7 aa, synthetic construct
  REGION 1..7: note = n-mer motif
RGDYVVH

SEQ ID NO: 8844 - protein, 7 aa, synthetic construct
  REGION 1..7: note = n-mer motif
RGDAARL

SEQ ID NO: 8845 - protein, 7 aa, synthetic construct
  REGION 1..7: note = n-mer motif
RGDYTGV

SEQ ID NO: 8846 - protein, 7 aa, synthetic construct
  REGION 1..7: note = n-mer motif
RGDLGGT

SEQ ID NO: 8847 - protein, 7 aa, synthetic construct
  REGION 1..7: note = n-mer motif
RGDTVYL

SEQ ID NO: 8848 - protein, 7 aa, synthetic construct
  REGION 1..7: note = n-mer motif
RGDLMGS

SEQ ID NO: 8849 - protein, 7 aa, synthetic construct
  REGION 1..7: note = n-mer motif
LGRGDVS

SEQ ID NO: 8850 - protein, 7 aa, synthetic construct
  REGION 1..7: note = n-mer motif
TAGRVQV

SEQ ID NO: 8851 - protein, 7 aa, synthetic construct
  REGION 1..7: note = n-mer motif
VVVRGGV

SEQ ID NO: 8852 - protein, 7 aa, synthetic construct
  REGION 1..7: note = n-mer motif
RGDHTNI

SEQ ID NO: 8853 - protein, 7 aa, synthetic construct
  REGION 1..7: note = n-mer motif
RGDLVGI

SEQ ID NO: 8854 - protein, 7 aa, synthetic construct
  REGION 1..7: note = n-mer motif
RGDLSPV

SEQ ID NO: 8855 - protein, 7 aa, synthetic construct
  REGION 1..7: note = n-mer motif
RGDLSGV

SEQ ID NO: 8856 - protein, 7 aa, synthetic construct
  REGION 1..7: note = n-mer motif
YGIAARS

SEQ ID NO: 8857 - protein, 7 aa, synthetic construct
  REGION 1..7: note = n-mer motif
RGDREGL

SEQ ID NO: 8858 - protein, 7 aa, synthetic construct
  REGION 1..7: note = n-mer motif
RGDLHST

SEQ ID NO: 8859 - protein, 7 aa, synthetic construct
  REGION 1..7: note = n-mer motif
RGDATGW

SEQ ID NO: 8860 - protein, 7 aa, synthetic construct
  REGION 1..7: note = n-mer motif
RGDQSHV

SEQ ID NO: 8861 - protein, 7 aa, synthetic construct
  REGION 1..7: note = n-mer motif
DKRVGTP

SEQ ID NO: 8862 - protein, 7 aa, synthetic construct
  REGION 1..7: note = n-mer motif
RGDLVVT

SEQ ID NO: 8863 - protein, 7 aa, synthetic construct
  REGION 1..7: note = n-mer motif
RGDFGGV

SEQ ID NO: 8864 - protein, 7 aa, synthetic construct
  REGION 1..7: note = n-mer motif
RGDLSNT

SEQ ID NO: 8865 - protein, 7 aa, synthetic construct
  REGION 1..7: note = n-mer motif
HRGQAVD

SEQ ID NO: 8866 - protein, 7 aa, synthetic construct
  REGION 1..7: note = n-mer motif
SMVRSGT

SEQ ID NO: 8867 - protein, 7 aa, synthetic construct
  REGION 1..7: note = n-mer motif
TSVSVKY

SEQ ID NO: 8868 - protein, 7 aa, synthetic construct
  REGION 1..7: note = n-mer motif
RGDYSQI

SEQ ID NO: 8869 - protein, 7 aa, synthetic construct
  REGION 1..7: note = n-mer motif
RGDISGV

SEQ ID NO: 8870 - protein, 7 aa, synthetic construct
  REGION 1..7: note = n-mer motif
RGDVAGV

SEQ ID NO: 8871 - protein, 7 aa, synthetic construct
  REGION 1..7: note = n-mer motif
RGDQVTI

SEQ ID NO: 8872 - protein, 7 aa, synthetic construct
  REGION 1..7: note = n-mer motif
RGDRLVI

SEQ ID NO: 8873 - protein, 7 aa, synthetic construct
  REGION 1..7: note = n-mer motif
PLLRSGT

SEQ ID NO: 8874 - protein, 7 aa, synthetic construct
  REGION 1..7: note = n-mer motif
RGDFGSV

SEQ ID NO: 8875 - protein, 7 aa, synthetic construct
  REGION 1..7: note = n-mer motif
RGDVAYV

SEQ ID NO: 8876 - protein, 7 aa, synthetic construct
  REGION 1..7: note = n-mer motif
ARMGTGV

SEQ ID NO: 8877 - protein, 7 aa, synthetic construct
  REGION 1..7: note = n-mer motif
VMRVGHA

SEQ ID NO: 8878 - protein, 7 aa, synthetic construct
  REGION 1..7: note = n-mer motif
ARVQSSP

SEQ ID NO: 8879 - protein, 7 aa, synthetic construct
  REGION 1..7: note = n-mer motif
RGDGGIL

SEQ ID NO: 8880 - protein, 7 aa, synthetic construct
  REGION 1..7: note = n-mer motif
RSDLGAL

SEQ ID NO: 8881 - protein, 7 aa, synthetic construct
  REGION 1..7: note = n-mer motif
SYSRSAV

SEQ ID NO: 8882 - protein, 7 aa, synthetic construct
  REGION 1..7: note = n-mer motif
RGDVLLV

SEQ ID NO: 8883 - protein, 7 aa, synthetic construct
  REGION 1..7: note = n-mer motif
TGVHTRV

SEQ ID NO: 8884 - protein, 7 aa, synthetic construct
  REGION 1..7: note = n-mer motif
TVGNLRG

SEQ ID NO: 8885 - protein, 7 aa, synthetic construct
  REGION 1..7: note = n-mer motif
TVVGQGY

SEQ ID NO: 8886 - protein, 7 aa, synthetic construct
  REGION 1..7: note = n-mer motif
RGDGGAL

SEQ ID NO: 8887 - protein, 7 aa, synthetic construct
  REGION 1..7: note = n-mer motif
NSYHAGA

SEQ ID NO: 8888 - protein, 7 aa, synthetic construct
  REGION 1..7: note = n-mer motif
RGDLTVT

SEQ ID NO: 8889 - protein, 7 aa, synthetic construct
  REGION 1..7: note = n-mer motif
RGDVHGF

SEQ ID NO: 8890 - DNA, 21 bp, synthetic construct
  misc_feature 1..21: note = n-mer motif encoding sequence
  source 1..21: mol_type = other DNA
cggggtgattatgtggggctg

SEQ ID NO: 8891 - DNA, 21 bp, synthetic construct
  misc_feature 1..21: note = n-mer motif encoding sequence
  source 1..21: mol_type = other DNA
cggggtgattattcgagtgtt

SEQ ID NO: 8892 - DNA, 21 bp, synthetic construct
  misc_feature 1..21: note = n-mer motif encoding sequence
  source 1..21: mol_type = other DNA
cggggtgattattcggggttg

SEQ ID NO: 8893 - DNA, 21 bp, synthetic construct
  misc_feature 1..21: note = n-mer motif encoding sequence
  source 1..21: mol_type = other DNA
cgtggtgatcatgagcgtttg

SEQ ID NO: 8894 - DNA, 21 bp, synthetic construct
  misc_feature 1..21: note = n-mer motif encoding sequence
  source 1..21: mol_type = other DNA
aggggggacctgacagtcacg

SEQ ID NO: 8895 - DNA, 21 bp, synthetic construct
  misc_feature 1..21: note = n-mer motif encoding sequence
  source 1..21: mol_type = other DNA
aggggcgactaccacgccatc

SEQ ID NO: 8896 - DNA, 21 bp, synthetic construct
  misc_feature 1..21: note = n-mer motif encoding sequence
  source 1..21: mol_type = other DNA
agaggagactaccgggaactc

SEQ ID NO: 8897 - DNA, 21 bp, synthetic construct
  misc_feature 1..21: note = n-mer motif encoding sequence
  source 1..21: mol_type = other DNA
cggggtgatcatggggttctt

SEQ ID NO: 8898 - DNA, 21 bp, synthetic construct
  misc_feature 1..21: note = n-mer motif encoding sequence
  source 1..21: mol_type = other DNA
cgtggtgatcatgcttcttgg

SEQ ID NO: 8899 - DNA, 21 bp, synthetic construct
  misc_feature 1..21: note = n-mer motif encoding sequence
  source 1..21: mol_type = other DNA
cgtggcgactactctggtcta

SEQ ID NO: 8900 - DNA, 21 bp, synthetic construct
  misc_feature 1..21: note = n-mer motif encoding sequence
  source 1..21: mol_type = other DNA
cgtggggatgcgatgcatctg

SEQ ID NO: 8901 - DNA, 21 bp, synthetic construct
  misc_feature 1..21: note = n-mer motif encoding sequence
  source 1..21: mol_type = other DNA
cgtggggatcatgtgtctttg

SEQ ID NO: 8902 - DNA, 21 bp, synthetic construct
  misc_feature 1..21: note = n-mer motif encoding sequence
  source 1..21: mol_type = other DNA
cggggggatcatgggcagttg

SEQ ID NO: 8903 - DNA, 21 bp, synthetic construct
  misc_feature 1..21: note = n-mer motif encoding sequence
  source 1..21: mol_type = other DNA
cgtggtgattatggtgggctg

SEQ ID NO: 8904 - DNA, 21 bp, synthetic construct
  misc_feature 1..21: note = n-mer motif encoding sequence
  source 1..21: mol_type = other DNA
cgaggcgactacgtgactatg

SEQ ID NO: 8905 - DNA, 21 bp, synthetic construct
  misc_feature 1..21: note = n-mer motif encoding sequence
  source 1..21: mol_type = other DNA
cgcggggaccactctacctgg

SEQ ID NO: 8906 - DNA, 21 bp, synthetic construct
  misc_feature 1..21: note = n-mer motif encoding sequence
  source 1..21: mol_type = other DNA
aggggcgacctgtctggcacc

SEQ ID NO: 8907 - DNA, 21 bp, synthetic construct
  misc_feature 1..21: note = n-mer motif encoding sequence
  source 1..21: mol_type = other DNA
cggggggattatcgtgagatg

SEQ ID NO: 8908 - DNA, 21 bp, synthetic construct
  misc_feature 1..21: note = n-mer motif encoding sequence
  source 1..21: mol_type = other DNA
agaggggacaccgaaagattg

SEQ ID NO: 8909 - DNA, 21 bp, synthetic construct
  misc_feature 1..21: note = n-mer motif encoding sequence
  source 1..21: mol_type = other DNA
cggggtgatcatagtacttgg

SEQ ID NO: 8910 - DNA, 21 bp, synthetic construct
  misc_feature 1..21: note = n-mer motif encoding sequence
  source 1..21: mol_type = other DNA
cgtggtgatctttcgggtacg

SEQ ID NO: 8911 - DNA, 21 bp, synthetic construct
  misc_feature 1..21: note = n-mer motif encoding sequence
  source 1..21: mol_type = other DNA
cggggggatcatgcttcttgg

SEQ ID NO: 8912 - DNA, 21 bp, synthetic construct
  misc_feature 1..21: note = n-mer motif encoding sequence
  source 1..21: mol_type = other DNA
cggggtgatctttcgagtgtt

SEQ ID NO: 8913 - DNA, 21 bp, synthetic construct
  misc_feature 1..21: note = n-mer motif encoding sequence
  source 1..21: mol_type = other DNA
cgaggagacacggtggtccta

SEQ ID NO: 8914 - DNA, 21 bp, synthetic construct
  misc_feature 1..21: note = n-mer motif encoding sequence
  source 1..21: mol_type = other DNA
cgtggggacgcggctgggttg

SEQ ID NO: 8915 - DNA, 21 bp, synthetic construct
  misc_feature 1..21: note = n-mer motif encoding sequence
  source 1..21: mol_type = other DNA
cggggtgatggtgcgactctg

SEQ ID NO: 8916 - DNA, 21 bp, synthetic construct
  misc_feature 1..21: note = n-mer motif encoding sequence
  source 1..21: mol_type = other DNA
aggggtgattatgcgtctctt

SEQ ID NO: 8917 - DNA, 21 bp, synthetic construct
  misc_feature 1..21: note = n-mer motif encoding sequence
  source 1..21: mol_type = other DNA
atgactgctcggaatccgatg

SEQ ID NO: 8918 - DNA, 21 bp, synthetic construct
  misc_feature 1..21: note = n-mer motif encoding sequence
  source 1..21: mol_type = other DNA
tatgtggtggggagtaggagt

SEQ ID NO: 8919 - DNA, 21 bp, synthetic construct
  misc_feature 1..21: note = n-mer motif encoding sequence
  source 1..21: mol_type = other DNA
tatgcggtggggagtaggagt

SEQ ID NO: 8920 - DNA, 21 bp, synthetic construct
  misc_feature 1..21: note = n-mer motif encoding sequence
  source 1..21: mol_type = other DNA
cgcggggactacgtaggttta

SEQ ID NO: 8921 - DNA, 21 bp, synthetic construct
  misc_feature 1..21: note = n-mer motif encoding sequence
  source 1..21: mol_type = other DNA
cggggtgacctgacaaccacg

SEQ ID NO: 8922 - DNA, 21 bp, synthetic construct
  misc_feature 1..21: note = n-mer motif encoding sequence
  source 1..21: mol_type = other DNA
cgcggtgactacgaacgacta

SEQ ID NO: 8923 - DNA, 21 bp, synthetic construct
  misc_feature 1..21: note = n-mer motif encoding sequence
  source 1..21: mol_type = other DNA
cgtggtgattatcgtgagttg

SEQ ID NO: 8924 - DNA, 21 bp, synthetic construct
  misc_feature 1..21: note = n-mer motif encoding sequence
  source 1..21: mol_type = other DNA
cgcggagaccacggtgtatta

SEQ ID NO: 8925 - DNA, 21 bp, synthetic construct
  misc_feature 1..21: note = n-mer motif encoding sequence
  source 1..21: mol_type = other DNA
cgtggtgattatcatgctatt

SEQ ID NO: 8926 - DNA, 21 bp, synthetic construct
  misc_feature 1..21: note = n-mer motif encoding sequence
  source 1..21: mol_type = other DNA
cgcggagaccacacgcaatgg

SEQ ID NO: 8927 - DNA, 21 bp, synthetic construct
  misc_feature 1..21: note = n-mer motif encoding sequence
  source 1..21: mol_type = other DNA
cggggtgatttgttggggact

SEQ ID NO: 8928 - DNA, 21 bp, synthetic construct
  misc_feature 1..21: note = n-mer motif encoding sequence
  source 1..21: mol_type = other DNA
cggggtgatttgacgggggtg

SEQ ID NO: 8929 - DNA, 21 bp, synthetic construct
  misc_feature 1..21: note = n-mer motif encoding sequence
  source 1..21: mol_type = other DNA
cgtggcgactcctacaccttg

SEQ ID NO: 8930 - DNA, 21 bp, synthetic construct
  misc_feature 1..21: note = n-mer motif encoding sequence
  source 1..21: mol_type = other DNA
cgcggagactacggaacggtc

SEQ ID NO: 8931 - DNA, 21 bp, synthetic construct
  misc_feature 1..21: note = n-mer motif encoding sequence
  source 1..21: mol_type = other DNA
aggggtgacgtcgtaggcctg

SEQ ID NO: 8932 - DNA, 21 bp, synthetic construct
  misc_feature 1..21: note = n-mer motif encoding sequence
  source 1..21: mol_type = other DNA
cggggtgatactgagcgtctg

SEQ ID NO: 8933 - DNA, 21 bp, synthetic construct
  misc_feature 1..21: note = n-mer motif encoding sequence
  source 1..21: mol_type = other DNA
cgcggcgaccactcctcattg

SEQ ID NO: 8934 - DNA, 21 bp, synthetic construct
  misc_feature 1..21: note = n-mer motif encoding sequence
  source 1..21: mol_type = other DNA
aggggcgaccacggtcaactt

SEQ ID NO: 8935 - DNA, 21 bp, synthetic construct
  misc_feature 1..21: note = n-mer motif encoding sequence
  source 1..21: mol_type = other DNA
cgtggcgacgtaactggaatg

SEQ ID NO: 8936 - DNA, 21 bp, synthetic construct
  misc_feature 1..21: note = n-mer motif encoding sequence
  source 1..21: mol_type = other DNA
cgcggcgactacgggggctta

SEQ ID NO: 8937 - DNA, 21 bp, synthetic construct
  misc_feature 1..21: note = n-mer motif encoding sequence
  source 1..21: mol_type = other DNA
cgtggggattatgcggggcat

SEQ ID NO: 8938 - DNA, 21 bp, synthetic construct
  misc_feature 1..21: note = n-mer motif encoding sequence
  source 1..21: mol_type = other DNA
aggggtgacatagtgggcctc

SEQ ID NO: 8939 - DNA, 21 bp, synthetic construct
  misc_feature 1..21: note = n-mer motif encoding sequence
  source 1..21: mol_type = other DNA
aggggggatcttgtggggtat

SEQ ID NO: 8940 - DNA, 21 bp, synthetic construct
  misc_feature 1..21: note = n-mer motif encoding sequence
  source 1..21: mol_type = other DNA
cgtggtgatggtgctcatctg

SEQ ID NO: 8941 - DNA, 21 bp, synthetic construct
  misc_feature 1..21: note = n-mer motif encoding sequence
  source 1..21: mol_type = other DNA
cgtggtgatcaggttgtggtt

SEQ ID NO: 8942 - DNA, 21 bp, synthetic construct
  misc_feature 1..21: note = n-mer motif encoding sequence
  source 1..21: mol_type = other DNA
cgtggggatacgatgggtatg

SEQ ID NO: 8943 - DNA, 21 bp, synthetic construct
  misc_feature 1..21: note = n-mer motif encoding sequence
  source 1..21: mol_type = other DNA
cgtggggatttgttggggact

SEQ ID NO: 8944 - DNA, 21 bp, synthetic construct
  misc_feature 1..21: note = n-mer motif encoding sequence
  source 1..21: mol_type = other DNA
cgtggggatctttctggtaat

SEQ ID NO: 8945 - DNA, 21 bp, synthetic construct
  misc_feature 1..21: note = n-mer motif encoding sequence
  source 1..21: mol_type = other DNA
ttcaacgtaagtacgagaaca

SEQ ID NO: 8946 - DNA, 21 bp, synthetic construct
  misc_feature 1..21: note = n-mer motif encoding sequence
  source 1..21: mol_type = other DNA
cgtggtgatcgtactgtgatt

SEQ ID NO: 8947 - DNA, 21 bp, synthetic construct
  misc_feature 1..21: note = n-mer motif encoding sequence
  source 1..21: mol_type = other DNA
cgtggtgatgttagtgggatt

SEQ ID NO: 8948 - DNA, 21 bp, synthetic construct
  misc_feature 1..21: note = n-mer motif encoding sequence
  source 1..21: mol_type = other DNA
cggggcgactacgcaagcctg

SEQ ID NO: 8949 - DNA, 21 bp, synthetic construct
  misc_feature 1..21: note = n-mer motif encoding sequence
  source 1..21: mol_type = other DNA
cgtggtgatcaggcgcttatt

SEQ ID NO: 8950 - DNA, 21 bp, synthetic construct
  misc_feature 1..21: note = n-mer motif encoding sequence
  source 1..21: mol_type = other DNA
cgtggtgatcgtgattcgtgg

SEQ ID NO: 8951 - DNA, 21 bp, synthetic construct
  misc_feature 1..21: note = n-mer motif encoding sequence
  source 1..21: mol_type = other DNA
cgtggtgatcgtgagggtctt

SEQ ID NO: 8952 - DNA, 21 bp, synthetic construct
  misc_feature 1..21: note = n-mer motif encoding sequence
  source 1..21: mol_type = other DNA
cggggagactacgtcagtgtc

SEQ ID NO: 8953 - DNA, 21 bp, synthetic construct
  misc_feature 1..21: note = n-mer motif encoding sequence
  source 1..21: mol_type = other DNA
cgcggagacacgatgagactg

SEQ ID NO: 8954 - DNA, 21 bp, synthetic construct
  misc_feature 1..21: note = n-mer motif encoding sequence
  source 1..21: mol_type = other DNA
aggggtgactacgctcacacg

SEQ ID NO: 8955 - DNA, 21 bp, synthetic construct
  misc_feature 1..21: note = n-mer motif encoding sequence
  source 1..21: mol_type = other DNA
cggggtgatacggagaagttg

SEQ ID NO: 8956 - DNA, 21 bp, synthetic construct
  misc_feature 1..21: note = n-mer motif encoding sequence
  source 1..21: mol_type = other DNA
aggggggatcagtggcaggtg

SEQ ID NO: 8957 - DNA, 21 bp, synthetic construct
  misc_feature 1..21: note = n-mer motif encoding sequence
  source 1..21: mol_type = other DNA
cggggtgatattctgaatgtg

SEQ ID NO: 8958 - DNA, 21 bp, synthetic construct
  misc_feature 1..21: note = n-mer motif encoding sequence
  source 1..21: mol_type = other DNA
cgtggtgatcgtgagcaggtt

SEQ ID NO: 8959 - DNA, 21 bp, synthetic construct
  misc_feature 1..21: note = n-mer motif encoding sequence
  source 1..21: mol_type = other DNA
cgaggcgacaactggcaaatg

SEQ ID NO: 8960 - DNA, 21 bp, synthetic construct
  misc_feature 1..21: note = n-mer motif encoding sequence
  source 1..21: mol_type = other DNA
aggggggattatggtgggatg

SEQ ID NO: 8961 - DNA, 21 bp, synthetic construct
  misc_feature 1..21: note = n-mer motif encoding sequence
  source 1..21: mol_type = other DNA
cgtggtgatctggatgggcgg

SEQ ID NO: 8962 - DNA, 21 bp, synthetic construct
  misc_feature 1..21: note = n-mer motif encoding sequence
  source 1..21: mol_type = other DNA
agaggggaccacgaacggctt

SEQ ID NO: 8963 - DNA, 21 bp, synthetic construct
  misc_feature 1..21: note = n-mer motif encoding sequence
  source 1..21: mol_type = other DNA
aggggtgatctgggtgtggtg

SEQ ID NO: 8964 - DNA, 21 bp, synthetic construct
  misc_feature 1..21: note = n-mer motif encoding sequence
  source 1..21: mol_type = other DNA
cgcggagaccgagaaagccac

SEQ ID NO: 8965 - DNA, 21 bp, synthetic construct
  misc_feature 1..21: note = n-mer motif encoding sequence
  source 1..21: mol_type = other DNA
cggggggatgctgcgacgatg

SEQ ID NO: 8966 - DNA, 21 bp, synthetic construct
  misc_feature 1..21: note = n-mer motif encoding sequence
  source 1..21: mol_type = other DNA
cgtggtgatttgggtggggtg

SEQ ID NO: 8967 - DNA, 21 bp, synthetic construct
  misc_feature 1..21: note = n-mer motif encoding sequence
  source 1..21: mol_type = other DNA
cggggtgatgcggggcagctt

SEQ ID NO: 8968 - DNA, 21 bp, synthetic construct
  misc_feature 1..21: note = n-mer motif encoding sequence
  source 1..21: mol_type = other DNA
cggggggatcgtggtgagatt

SEQ ID NO: 8969 - DNA, 21 bp, synthetic construct
  misc_feature 1..21: note = n-mer motif encoding sequence
  source 1..21: mol_type = other DNA
cgtggagacgtcgtaagttgg

SEQ ID NO: 8970 - DNA, 21 bp, synthetic construct
  misc_feature 1..21: note = n-mer motif encoding sequence
  source 1..21: mol_type = other DNA
atgactgctcggagtccgatg

SEQ ID NO: 8971 - DNA, 21 bp, synthetic construct
  misc_feature 1..21: note = n-mer motif encoding sequence
  source 1..21: mol_type = other DNA
acgatccgtgacggcaggttg

SEQ ID NO: 8972 - DNA, 21 bp, synthetic construct
  misc_feature 1..21: note = n-mer motif encoding sequence
  source 1..21: mol_type = other DNA
cgtggggatattgttggtctg

SEQ ID NO: 8973 - DNA, 21 bp, synthetic construct
  misc_feature 1..21: note = n-mer motif encoding sequence
  source 1..21: mol_type = other DNA
cgcggtgactaccaagcagtg

SEQ ID NO: 8974 - DNA, 21 bp, synthetic construct
  misc_feature 1..21: note = n-mer motif encoding sequence
  source 1..21: mol_type = other DNA
cgtggtgatggggcgcatatg

SEQ ID NO: 8975 - DNA, 21 bp, synthetic construct
  misc_feature 1..21: note = n-mer motif encoding sequence
  source 1..21: mol_type = other DNA
cggggtgatgctgcttcgatt

SEQ ID NO: 8976 - DNA, 21 bp, synthetic construct
  misc_feature 1..21: note = n-mer motif encoding sequence
  source 1..21: mol_type = other DNA
cgtggggataattctcagtgg

SEQ ID NO: 8977 - DNA, 21 bp, synthetic construct
  misc_feature 1..21: note = n-mer motif encoding sequence
  source 1..21: mol_type = other DNA
agaggcgaccactcgggcctc

SEQ ID NO: 8978 - DNA, 21 bp, synthetic construct
  misc_feature 1..21: note = n-mer motif encoding sequence
  source 1..21: mol_type = other DNA
cgaggcgacatgggaggcacc

SEQ ID NO: 8979 - DNA, 21 bp, synthetic construct
  misc_feature 1..21: note = n-mer motif encoding sequence
  source 1..21: mol_type = other DNA
aggggagacctcacaggtgta

SEQ ID NO: 8980 - DNA, 21 bp, synthetic construct
  misc_feature 1..21: note = n-mer motif encoding sequence
  source 1..21: mol_type = other DNA
cggggtgatgtgtctggttat

SEQ ID NO: 8981 - DNA, 21 bp, synthetic construct
  misc_feature 1..21: note = n-mer motif encoding sequence
  source 1..21: mol_type = other DNA
cgtggggatcttactacgact

SEQ ID NO: 8982 - DNA, 21 bp, synthetic construct
  misc_feature 1..21: note = n-mer motif encoding sequence
  source 1..21: mol_type = other DNA
aggggtgattatgggactgtt

SEQ ID NO: 8983 - DNA, 21 bp, synthetic construct
  misc_feature 1..21: note = n-mer motif encoding sequence
  source 1..21: mol_type = other DNA
cgcggtgacaccatgggcatg

SEQ ID NO: 8984 - DNA, 21 bp, synthetic construct
  misc_feature 1..21: note = n-mer motif encoding sequence
  source 1..21: mol_type = other DNA
cgtggggattattcgtctgtg

SEQ ID NO: 8985 - DNA, 21 bp, synthetic construct
  misc_feature 1..21: note = n-mer motif encoding sequence
  source 1..21: mol_type = other DNA
cggggtgactacggcggtatg

SEQ ID NO: 8986 - DNA, 21 bp, synthetic construct
  misc_feature 1..21: note = n-mer motif encoding sequence
  source 1..21: mol_type = other DNA
cgtggggattatgtgtctgtg

SEQ ID NO: 8987 - DNA, 21 bp, synthetic construct
  misc_feature 1..21: note = n-mer motif encoding sequence
  source 1..21: mol_type = other DNA
cgtggagacgtgaccggactg

SEQ ID NO: 8988 - DNA, 21 bp, synthetic construct
  misc_feature 1..21: note = n-mer motif encoding sequence
  source 1..21: mol_type = other DNA
cgaggtgaccttctcacaaac

SEQ ID NO: 8989 - DNA, 21 bp, synthetic construct
  misc_feature 1..21: note = n-mer motif encoding sequence
  source 1..21: mol_type = other DNA
cgtggtgatcatagtggttgg

SEQ ID NO: 8990 - DNA, 21 bp, synthetic construct
  misc_feature 1..21: note = n-mer motif encoding sequence
  source 1..21: mol_type = other DNA
gttagtcggggtgatgtgcct

SEQ ID NO: 8991 - DNA, 21 bp, synthetic construct
  misc_feature 1..21: note = n-mer motif encoding sequence
  source 1..21: mol_type = other DNA
cgtggtgatgtgagtgggatg

SEQ ID NO: 8992 - DNA, 21 bp, synthetic construct
  misc_feature 1..21: note = n-mer motif encoding sequence
  source 1..21: mol_type = other DNA
cggggagaccgcgtgggcatg

SEQ ID NO: 8993 - DNA, 21 bp, synthetic construct
  misc_feature 1..21: note = n-mer motif encoding sequence
  source 1..21: mol_type = other DNA
cgtggggatggtggtgtgctt

SEQ ID NO: 8994 - DNA, 21 bp, synthetic construct
  misc_feature 1..21: note = n-mer motif encoding sequence
  source 1..21: mol_type = other DNA
aggggtgattatgtgacgatt

SEQ ID NO: 8995 - DNA, 21 bp, synthetic construct
  misc_feature 1..21: note = n-mer motif encoding sequence
  source 1..21: mol_type = other DNA
cggggtgatattgctggtgtt

SEQ ID NO: 8996 - DNA, 21 bp, synthetic construct
  misc_feature 1..21: note = n-mer motif encoding sequence
  source 1..21: mol_type = other DNA
cgcggagacagagaacaagtg

SEQ ID NO: 8997 - DNA, 21 bp, synthetic construct
  misc_feature 1..21: note = n-mer motif encoding sequence
  source 1..21: mol_type = other DNA
cgtggggatttggataataag

SEQ ID NO: 8998 - DNA, 21 bp, synthetic construct
  misc_feature 1..21: note = n-mer motif encoding sequence
  source 1..21: mol_type = other DNA
cgtggtgatctgacgtctgtt

SEQ ID NO: 8999 - DNA, 21 bp, synthetic construct
  misc_feature 1..21: note = n-mer motif encoding sequence
  source 1..21: mol_type = other DNA
ttcaacgtaagtgttcgcaac

SEQ ID NO: 9000 - DNA, 21 bp, synthetic construct
  misc_feature 1..21: note = n-mer motif encoding sequence
  source 1..21: mol_type = other DNA
cgtggtgatctggttcatact

SEQ ID NO: 9001 - DNA, 21 bp, synthetic construct
  misc_feature 1..21: note = n-mer motif encoding sequence
  source 1..21: mol_type = other DNA
aggggtgaccacggtgtgata

SEQ ID NO: 9002 - DNA, 21 bp, synthetic construct
  misc_feature 1..21: note = n-mer motif encoding sequence
  source 1..21: mol_type = other DNA
cgtggtgatgctcgtgagatg

SEQ ID NO: 9003 - DNA, 21 bp, synthetic construct
  misc_feature 1..21: note = n-mer motif encoding sequence
  source 1..21: mol_type = other DNA
cgtggtgatcaggcgtcttat

SEQ ID NO: 9004 - DNA, 21 bp, synthetic construct
  misc_feature 1..21: note = n-mer motif encoding sequence
  source 1..21: mol_type = other DNA
aggggggatcattctagtctg

SEQ ID NO: 9005 - DNA, 21 bp, synthetic construct
  misc_feature 1..21: note = n-mer motif encoding sequence
  source 1..21: mol_type = other DNA
cgaggcgacgttcgggtcata

SEQ ID NO: 9006 - DNA, 21 bp, synthetic construct
  misc_feature 1..21: note = n-mer motif encoding sequence
  source 1..21: mol_type = other DNA
acggttggtcgtggtgatacg

SEQ ID NO: 9007 - DNA, 21 bp, synthetic construct
  misc_feature 1..21: note = n-mer motif encoding sequence
  source 1..21: mol_type = other DNA
cgaggcgaccacggttcactg

SEQ ID NO: 9008 - DNA, 21 bp, synthetic construct
  misc_feature 1..21: note = n-mer motif encoding sequence
  source 1..21: mol_type = other DNA
cgaggggacttcgaacgaacc

SEQ ID NO: 9009 - DNA, 21 bp, synthetic construct
  misc_feature 1..21: note = n-mer motif encoding sequence
  source 1..21: mol_type = other DNA
cgtggtgatcatagtgggctt

SEQ ID NO: 9010 - DNA, 21 bp, synthetic construct
  misc_feature 1..21: note = n-mer motif encoding sequence
  source 1..21: mol_type = other DNA
agaggcgacatgtctacggtg

SEQ ID NO: 9011 - DNA, 21 bp, synthetic construct
  misc_feature 1..21: note = n-mer motif encoding sequence
  source 1..21: mol_type = other DNA
cggggtgattatgctacgctt

SEQ ID NO: 9012 - DNA, 21 bp, synthetic construct
  misc_feature 1..21: note = n-mer motif encoding sequence
  source 1..21: mol_type = other DNA
ctgcctggtgtgggtcatgct

SEQ ID NO: 9013 - DNA, 21 bp, synthetic construct
  misc_feature 1..21: note = n-mer motif encoding sequence
  source 1..21: mol_type = other DNA
aggggcgacgcgctccacctt

SEQ ID NO: 9014 - DNA, 21 bp, synthetic construct
  misc_feature 1..21: note = n-mer motif encoding sequence
  source 1..21: mol_type = other DNA
agcgggggaacgtaccttgcc

SEQ ID NO: 9015 - DNA, 21 bp, synthetic construct
  misc_feature 1..21: note = n-mer motif encoding sequence
  source 1..21: mol_type = other DNA
aggggtgatgttgtgcatctg

SEQ ID NO: 9016 - DNA, 21 bp, synthetic construct
  misc_feature 1..21: note = n-mer motif encoding sequence
  source 1..21: mol_type = other DNA
cggggtgatcaggtgcagctg

SEQ ID NO: 9017 - DNA, 21 bp, synthetic construct
  misc_feature 1..21: note = n-mer motif encoding sequence
  source 1..21: mol_type = other DNA
tcgtcgattggtgtgaagatt

SEQ ID NO: 9018 - DNA, 21 bp, synthetic construct
  misc_feature 1..21: note = n-mer motif encoding sequence
  source 1..21: mol_type = other DNA
cgcggcgaccacatgtctcta

SEQ ID NO: 9019 - DNA, 21 bp, synthetic construct
  misc_feature 1..21: note = n-mer motif encoding sequence
  source 1..21: mol_type = other DNA
aggggggatatgagtactgtt

SEQ ID NO: 9020 - DNA, 21 bp, synthetic construct
  misc_feature 1..21: note = n-mer motif encoding sequence
  source 1..21: mol_type = other DNA
gttatgcgagcaggtgcgacg

SEQ ID NO: 9021 - DNA, 21 bp, synthetic construct
  misc_feature 1..21: note = n-mer motif encoding sequence
  source 1..21: mol_type = other DNA
cggggggatgttgttgggctt

SEQ ID NO: 9022 - DNA, 21 bp, synthetic construct
  misc_feature 1..21: note = n-mer motif encoding sequence
  source 1..21: mol_type = other DNA
cgtggtgatactgttgtgttg

SEQ ID NO: 9023 - DNA, 21 bp, synthetic construct
  misc_feature 1..21: note = n-mer motif encoding sequence
  source 1..21: mol_type = other DNA
gggacgaaggttggtgtgctg

SEQ ID NO: 9024 - DNA, 21 bp, synthetic construct
  misc_feature 1..21: note = n-mer motif encoding sequence
  source 1..21: mol_type = other DNA
acaggagtgcacacccgggtt

SEQ ID NO: 9025 - DNA, 21 bp, synthetic construct
  misc_feature 1..21: note = n-mer motif encoding sequence
  source 1..21: mol_type = other DNA
cgtggtgatgctggggttctt

SEQ ID NO: 9026 - DNA, 21 bp, synthetic construct
  misc_feature 1..21: note = n-mer motif encoding sequence
  source 1..21: mol_type = other DNA
cgtggtgatctttcgactact

SEQ ID NO: 9027 - DNA, 21 bp, synthetic construct
  misc_feature 1..21: note = n-mer motif encoding sequence
  source 1..21: mol_type = other DNA
cgtggtgatcggcttcagatt

SEQ ID NO: 9028 - DNA, 21 bp, synthetic construct
  misc_feature 1..21: note = n-mer motif encoding sequence
  source 1..21: mol_type = other DNA
cgtggggatgcggtgactttg

SEQ ID NO: 9029 - DNA, 21 bp, synthetic construct
  misc_feature 1..21: note = n-mer motif encoding sequence
  source 1..21: mol_type = other DNA
cggggggatatggttagtgtg

SEQ ID NO: 9030 - DNA, 21 bp, synthetic construct
  misc_feature 1..21: note = n-mer motif encoding sequence
  source 1..21: mol_type = other DNA
cgtggggatagggagaatctt

SEQ ID NO: 9031 - DNA, 21 bp, synthetic construct
  misc_feature 1..21: note = n-mer motif encoding sequence
  source 1..21: mol_type = other DNA
cgtggggatggtgcggcgatg

SEQ ID NO: 9032 - DNA, 21 bp, synthetic construct
  misc_feature 1..21: note = n-mer motif encoding sequence
  source 1..21: mol_type = other DNA
cggggggatcttactaggacg

SEQ ID NO: 9033 - DNA, 21 bp, synthetic construct
  misc_feature 1..21: note = n-mer motif encoding sequence
  source 1..21: mol_type = other DNA
cgtggggattatggtggtatt

SEQ ID NO: 9034 - DNA, 21 bp, synthetic construct
  misc_feature 1..21: note = n-mer motif encoding sequence
  source 1..21: mol_type = other DNA
cggggtgatatggagcctcgt

SEQ ID NO: 9035 - DNA, 21 bp, synthetic construct
  misc_feature 1..21: note = n-mer motif encoding sequence
  source 1..21: mol_type = other DNA
cgtggggatacggcggttcag

SEQ ID NO: 9036 - DNA, 21 bp, synthetic construct
  misc_feature 1..21: note = n-mer motif encoding sequence
  source 1..21: mol_type = other DNA
gctgtgactaggggtggtgtt

SEQ ID NO: 9037 - DNA, 21 bp, synthetic construct
  misc_feature 1..21: note = n-mer motif encoding sequence
  source 1..21: mol_type = other DNA
gtgagtgcggcgcgttctctg

SEQ ID NO: 9038 - DNA, 21 bp, synthetic construct
  misc_feature 1..21: note = n-mer motif encoding sequence
  source 1..21: mol_type = other DNA
ggtcggcttcctcagcagact

SEQ ID NO: 9039 - DNA, 21 bp, synthetic construct
  misc_feature 1..21: note = n-mer motif encoding sequence
  source 1..21: mol_type = other DNA
cgaggcgacttggttggttac

SEQ ID NO: 9040 - DNA, 21 bp, synthetic construct
  misc_feature 1..21: note = n-mer motif encoding sequence
  source 1..21: mol_type = other DNA
cggggggatctggttacggtt

SEQ ID NO: 9041 - DNA, 21 bp, synthetic construct
  misc_feature 1..21: note = n-mer motif encoding sequence
  source 1..21: mol_type = other DNA
cgcggggactacgtcgttcac

SEQ ID NO: 9042 - DNA, 21 bp, synthetic construct
  misc_feature 1..21: note = n-mer motif encoding sequence
  source 1..21: mol_type = other DNA
cgcggcgacgctgcacgacta

SEQ ID NO: 9043 - DNA, 21 bp, synthetic construct
  misc_feature 1..21: note = n-mer motif encoding sequence
  source 1..21: mol_type = other DNA
aggggtgactacacaggcgtc

SEQ ID NO: 9044 - DNA, 21 bp, synthetic construct
  misc_feature 1..21: note = n-mer motif encoding sequence
  source 1..21: mol_type = other DNA
aggggtgatcttgggggtacg

SEQ ID NO: 9045 - DNA, 21 bp, synthetic construct
  misc_feature 1..21: note = n-mer motif encoding sequence
  source 1..21: mol_type = other DNA
cggggtgatacggtgtatctg

SEQ ID NO: 9046 - DNA, 21 bp, synthetic construct
  misc_feature 1..21: note = n-mer motif encoding sequence
  source 1..21: mol_type = other DNA
cggggggatcttatggggagt

SEQ ID NO: 9047 - DNA, 21 bp, synthetic construct
  misc_feature 1..21: note = n-mer motif encoding sequence
  source 1..21: mol_type = other DNA
ttgggtcggggtgatgtgtcg

SEQ ID NO: 9048 - DNA, 21 bp, synthetic construct
  misc_feature 1..21: note = n-mer motif encoding sequence
  source 1..21: mol_type = other DNA
actgctgggcgtgttcaggtg

SEQ ID NO: 9049 - DNA, 21 bp, synthetic construct
  misc_feature 1..21: note = n-mer motif encoding sequence
  source 1..21: mol_type = other DNA
gtggtggtgcgtggtggggtt

SEQ ID NO: 9050 - DNA, 21 bp, synthetic construct
  misc_feature 1..21: note = n-mer motif encoding sequence
  source 1..21: mol_type = other DNA
agaggggaccacactaacatc

SEQ ID NO: 9051 - DNA, 21 bp, synthetic construct
  misc_feature 1..21: note = n-mer motif encoding sequence
  source 1..21: mol_type = other DNA
aggggcgacttagtaggaatc

SEQ ID NO: 9052 - DNA, 21 bp, synthetic construct
  misc_feature 1..21: note = n-mer motif encoding sequence
  source 1..21: mol_type = other DNA
agaggagacttgtccccggtg

SEQ ID NO: 9053 - DNA, 21 bp, synthetic construct
  misc_feature 1..21: note = n-mer motif encoding sequence
  source 1..21: mol_type = other DNA
cggggtgatttgtcgggggtt

SEQ ID NO: 9054 - DNA, 21 bp, synthetic construct
  misc_feature 1..21: note = n-mer motif encoding sequence
  source 1..21: mol_type = other DNA
tacggcatcgcagcaagatct

SEQ ID NO: 9055 - DNA, 21 bp, synthetic construct
  misc_feature 1..21: note = n-mer motif encoding sequence
  source 1..21: mol_type = other DNA
cggggggaccgagaagggcta

SEQ ID NO: 9056 - DNA, 21 bp, synthetic construct
  misc_feature 1..21: note = n-mer motif encoding sequence
  source 1..21: mol_type = other DNA
cgtggtgatttgcattcgacg

SEQ ID NO: 9057 - DNA, 21 bp, synthetic construct
  misc_feature 1..21: note = n-mer motif encoding sequence
  source 1..21: mol_type = other DNA
cggggtgatgcgacgggttgg

SEQ ID NO: 9058 - DNA, 21 bp, synthetic construct
  misc_feature 1..21: note = n-mer motif encoding sequence
  source 1..21: mol_type = other DNA
cgaggcgaccaaagccacgta

SEQ ID NO: 9059 - DNA, 21 bp, synthetic construct
  misc_feature 1..21: note = n-mer motif encoding sequence
  source 1..21: mol_type = other DNA
gataagagggttgggactcct

SEQ ID NO: 9060 - DNA, 21 bp, synthetic construct
  misc_feature 1..21: note = n-mer motif encoding sequence
  source 1..21: mol_type = other DNA
agaggcgacctggtcgtaact

SEQ ID NO: 9061 - DNA, 21 bp, synthetic construct
  misc_feature 1..21: note = n-mer motif encoding sequence
  source 1..21: mol_type = other DNA
aggggtgacttcggaggtgtc

SEQ ID NO: 9062 - DNA, 21 bp, synthetic construct
  misc_feature 1..21: note = n-mer motif encoding sequence
  source 1..21: mol_type = other DNA
cgtggagacctcagcaacaca

SEQ ID NO: 9063 - DNA, 21 bp, synthetic construct
  misc_feature 1..21: note = n-mer motif encoding sequence
  source 1..21: mol_type = other DNA
catcggggtcaggcggtggat

SEQ ID NO: 9064 - DNA, 21 bp, synthetic construct
  misc_feature 1..21: note = n-mer motif encoding sequence
  source 1..21: mol_type = other DNA
agtatggttcgttcggggacg

SEQ ID NO: 9065 - DNA, 21 bp, synthetic construct
  misc_feature 1..21: note = n-mer motif encoding sequence
  source 1..21: mol_type = other DNA
acttctgtgtcggtgaagtat

SEQ ID NO: 9066 - DNA, 21 bp, synthetic construct
  misc_feature 1..21: note = n-mer motif encoding sequence
  source 1..21: mol_type = other DNA
agaggcgactacagccaaata

SEQ ID NO: 9067 - DNA, 21 bp, synthetic construct
  misc_feature 1..21: note = n-mer motif encoding sequence
  source 1..21: mol_type = other DNA
cggggtgatatttcgggggtt

SEQ ID NO: 9068 - DNA, 21 bp, synthetic construct
  misc_feature 1..21: note = n-mer motif encoding sequence
  source 1..21: mol_type = other DNA
cggggtgatgtggcgggggtt

SEQ ID NO: 9069 - DNA, 21 bp, synthetic construct
  misc_feature 1..21: note = n-mer motif encoding sequence
  source 1..21: mol_type = other DNA
aggggtgatcaggttactatt

SEQ ID NO: 9070 - DNA, 21 bp, synthetic construct
  misc_feature 1..21: note = n-mer motif encoding sequence
  source 1..21: mol_type = other DNA
agaggagacaggctggtcatc

SEQ ID NO: 9071 - DNA, 21 bp, synthetic construct
  misc_feature 1..21: note = n-mer motif encoding sequence
  source 1..21: mol_type = other DNA
ccgttgttgaggagtgggacg

SEQ ID NO: 9072 - DNA, 21 bp, synthetic construct
  misc_feature 1..21: note = n-mer motif encoding sequence
  source 1..21: mol_type = other DNA
cggggtgattttggtagtgtg

SEQ ID NO: 9073 - DNA, 21 bp, synthetic construct
  misc_feature 1..21: note = n-mer motif encoding sequence
  source 1..21: mol_type = other DNA
cggggtgatgttgcttatgtg

SEQ ID NO: 9074 - DNA, 21 bp, synthetic construct
  misc_feature 1..21: note = n-mer motif encoding sequence
  source 1..21: mol_type = other DNA
gctcgtatgggtacgggtgtg

SEQ ID NO: 9075 - DNA, 21 bp, synthetic construct
  misc_feature 1..21: note = n-mer motif encoding sequence
  source 1..21: mol_type = other DNA
gtgatgcgtgtggggcatgct

SEQ ID NO: 9076 - DNA, 21 bp, synthetic construct
  misc_feature 1..21: note = n-mer motif encoding sequence
  source 1..21: mol_type = other DNA
gctcgtgttcagagttcgcct

SEQ ID NO: 9077 - DNA, 21 bp, synthetic construct
  misc_feature 1..21: note = n-mer motif encoding sequence
  source 1..21: mol_type = other DNA
cggggtgatggggggattctt

SEQ ID NO: 9078 - DNA, 21 bp, synthetic construct
  misc_feature 1..21: note = n-mer motif encoding sequence
  source 1..21: mol_type = other DNA
aggtctgatcttggggctttg

SEQ ID NO: 9079 - DNA, 21 bp, synthetic construct
  misc_feature 1..21: note = n-mer motif encoding sequence
  source 1..21: mol_type = other DNA
tcgtattcgcggagtgcggtt

SEQ ID NO: 9080 - DNA, 21 bp, synthetic construct
  misc_feature 1..21: note = n-mer motif encoding sequence
  source 1..21: mol_type = other DNA
aggggggatgttcttctggtg

SEQ ID NO: 9081 - DNA, 21 bp, synthetic construct
  misc_feature 1..21: note = n-mer motif encoding sequence
  source 1..21: mol_type = other DNA
acgggtgttcatacgagggtg

SEQ ID NO: 9082 - DNA, 21 bp, synthetic construct
  misc_feature 1..21: note = n-mer motif encoding sequence
  source 1..21: mol_type = other DNA
actgtggggaatttgcgtggt

SEQ ID NO: 9083 - DNA, 21 bp, synthetic construct
  misc_feature 1..21: note = n-mer motif encoding sequence
  source 1..21: mol_type = other DNA
actgtcgtcggacaaggttac

SEQ ID NO: 9084 - DNA, 21 bp, synthetic construct
  misc_feature 1..21: note = n-mer motif encoding sequence
  source 1..21: mol_type = other DNA
cgtggtgatggtggtgctctg

SEQ ID NO: 9085 - DNA, 21 bp, synthetic construct
  misc_feature 1..21: note = n-mer motif encoding sequence
  source 1..21: mol_type = other DNA
aacagctaccacgctggggcc

SEQ ID NO: 9086 - DNA, 21 bp, synthetic construct
  misc_feature 1..21: note = n-mer motif encoding sequence
  source 1..21: mol_type = other DNA
cggggtgatttgactgtgact

SEQ ID NO: 9087 - DNA, 21 bp, synthetic construct
  misc_feature 1..21: note = n-mer motif encoding sequence
  source 1..21: mol_type = other DNA
cggggagacgtccacggcttc

SEQ ID NO: 9088 - protein, 8 aa, synthetic construct
  REGION 1..8: note = Nuclear localization sequence
VSRKRPRP

SEQ ID NO: 9089 - protein, 8 aa, synthetic construct
  REGION 1..8: note = Nuclear localization sequence
PPKKARED

SEQ ID NO: 9090 - protein, 8 aa, synthetic construct
  REGION 1..8: note = Nuclear localization sequence
PQPKKKPL

SEQ ID NO: 9091 - protein, 12 aa, synthetic construct
  REGION 1..12: note = Nuclear localization sequence
SALIKKKKKMAP

SEQ ID NO: 9092 - protein, 5 aa, synthetic construct
  REGION 1..5: note = Nuclear localization sequence
DRLRR

SEQ ID NO: 9093 - protein, 7 aa, synthetic construct
  REGION 1..7: note = Nuclear localization sequence
PKQKKRK

SEQ ID NO: 9094 - protein, 10 aa, synthetic construct
  REGION 1..10: note = Nuclear localization sequence
RKLKKKIKKL

SEQ ID NO: 9095 - protein, 10 aa, synthetic construct
  REGION 1..10: note = Nuclear localization sequence
REKKKFLKRR

SEQ ID NO: 9096 - protein, 20 aa, synthetic construct
  REGION 1..20: note = Nuclear localization sequence
KRKGDEVDGVDEVAKKKSKK

SEQ ID NO: 9097 - protein, 17 aa, synthetic construct
  REGION 1..17: note = Nuclear localization sequence
RKCLQAGMNLEARKTKK

SEQ ID NO: 9098 - protein, 288 aa, synthetic construct
  REGION 1..288: note = N-terminal capping region
MDPIRSRTPSPARELLSGPQPDGVQPTADRGVSPPAGGPLDGLPARRTMSRTRLPSPPAPSPAFSADSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 9099 - protein, 183 aa, synthetic construct
  REGION 1..183: note = C-terminal capping region
RPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRAS

SEQ ID NO: 9100-9137 - skipped (38 entries)

What is claimed is:

1. A composition comprising a targeting moiety effective to target a muscle cell, wherein the targeting moiety comprises an n-mer motif comprising $X_m RGDYX_1X_2L$,
   wherein X is selected from any amino acid, and wherein m is 0-4.

2. The composition of claim 1, wherein $X_1$ is S and $X_2$ is G.

3. The composition of claim 2, wherein m is 3.

4. The composition of claim 3, wherein the first three amino acids of the n-mer motif are ESR, NNG, NT, SNN, SSN, or TDK.

5. The composition of claim 1, wherein $X_1$ is R and $X_2$ is E.

6. The composition of claim 5, wherein m is 3.

7. The composition of claim 6, wherein the first three amino acids of the n-mer motif are AAA, ATT, NNN, NNS, NSN, SNG, TAG, TAT, TNT, or TTI.

8. The composition of claim 1, wherein the targeting moiety is an engineered adeno associated virus (AAV) capsid polypeptide.

9. The composition of claim 8, wherein the n-mer motif is inserted into a surface variable region of the engineered AAV capsid polypeptide.

10. The composition of claim 9, wherein the surface variable region is selected from VR-IV, VR-V, or VR-VIII.

11. The composition of claim 8, wherein the n-mer motif is inserted between any two amino acids between amino acids 262-269, 327-332, 382-386, 452-460, 488-505, 527-539, 545-558, 581-593, 704-714, or any combination thereof, in an AAV9 capsid polypeptide or in an analogous position in an AAV1, AAV2, AAV3, AAV4, AAV5, AAV6, AAV7, AAV8, AAV rh.74, or AAV rh.10 capsid polypeptide; or is inserted between amino acids 588 and 589, in an AAV9 capsid polypeptide or in an analogous position in an AAV1, AAV2, AAV3, AAV4, AAV5, AAV6, AAV7, AAV8, AAV rh.74, or AAV rh.10 capsid polypeptide.

12. The composition of claim 1, further comprising a cargo.

13. The composition of claim 12, wherein the cargo is
(a) capable of treating or preventing a muscle disease or disorder;
(b) a morpholino; a peptide-linked morpholino; an antisense oligonucleotide; a PMO, a therapeutic transgene; a polynucleotide encoding a therapeutic polypeptide or peptide; a PPMO; one or more peptides or polypeptides; one or more polynucleotides encoding a CRISPR-Cas protein, a guide RNA, or both; a ribonucleoprotein, wherein the ribonucleoprotein comprises a CRISPR-Cas system molecule; a therapeutic transgene RNA, or other gene modifying or therapeutic RNA and/or protein; or any combination thereof; or
(c) both (a) and (b).

14. The composition of claim 13, wherein the muscle disease or disorder is an auto immune disease; a cancer; a muscular dystrophy; a neuro-muscular disease; a sugar or glycogen storage disease; an expanded repeat disease; a dominant negative disease; a cardiomyopathy; a viral disease; a progeroid disease; or any combination thereof.

15. An engineered particle comprising composition of claim 1.

16. The engineered particle of claim 15, wherein the wherein the targeting moiety is an engineered adeno associated virus (AAV) capsid polypeptide.

17. The engineered particle of claim 16, wherein the n-mer motif is inserted into a surface variable region of the engineered AAV capsid polypeptide.

18. The engineered particle of claim 17, wherein the surface variable region is selected from VR-IV, VR-V, or VR-VIII.

19. The engineered particle of claim 16, wherein the n-mer motif is inserted between any two amino acids between amino acids 262-269, 327-332, 382-386, 452-460, 488-505, 527-539, 545-558, 581-593, 704-714, or any combination thereof, in an AAV9 capsid polypeptide or in an analogous position in an AAV1, AAV2, AAV3, AAV4, AAV5, AAV6, AAV7, AAV8, AAV rh.74, or AAV rh.10 capsid polypeptide; or is inserted between amino acids 588 and 589, in an AAV9 capsid polypeptide or in an analogous position in an AAV1, AAV2, AAV3, AAV4, AAV5, AAV6, AAV7, AAV8, AAV rh.74, or AAV rh.10 capsid polypeptide.

20. The engineered particle of claim 15, wherein the engineered particle is an adeno associated virus (AAV) capsid.

21. The engineered particle of claim 15, further comprising a cargo.

22. The engineered particle of claim 21, wherein the cargo is
(a) capable of treating or preventing a muscle disease or disorder;
(b) a morpholino; a peptide-linked morpholino; an antisense oligonucleotide; a PMO, a therapeutic transgene; a polynucleotide encoding a therapeutic polypeptide or peptide; a PPMO; one or more peptides or polypeptides; one or more polynucleotides encoding a CRISPR-Cas protein, a guide RNA, or both; a ribonucleoprotein, wherein the ribonucleoprotein comprises a CRISPR-Cas system molecule; a therapeutic transgene RNA, or other gene modifying or therapeutic RNA and/or protein; or any combination thereof; or
(c) both (a) and (b).

23. The engineered particle of claim 22, wherein the muscle disease or disorder is an auto immune disease; a cancer; a muscular dystrophy; a neuro-muscular disease; a sugar or glycogen storage disease; an expanded repeat disease; a dominant negative disease; a cardiomyopathy; a viral disease; a progeroid disease; or any combination thereof.

24. A vector system comprising:
a polynucleotide encoding the composition of claim 1.

25. The vector system of claim 24, further comprising a cargo polynucleotide.

26. The vector system of claim 25, wherein the cargo polynucleotide
(a) is capable of treating or preventing a muscle disease or disorder;
(b) is or encodes a morpholino; a peptide-linked morpholino; an antisense oligonucleotide; a PMO, a therapeutic transgene; a polynucleotide encoding a therapeutic polypeptide or peptide; a PPMO; one or more peptides or polypeptides; one or more polynucleotides encoding a CRISPR-Cas protein, a guide RNA, or both; a ribonucleoprotein, wherein the ribonucleoprotein comprises a CRISPR-Cas system molecule; a therapeutic transgene RNA, or other gene modifying or therapeutic RNA and/or protein; or any combination thereof; or
(c) both (a) and (b).

27. A method of treating or preventing a muscle disease or disorder in a subject in need thereof, comprising:
administering a composition of claim 1 or an engineered particle comprising the composition to a subject in need thereof.

28. The method of claim 27, wherein the composition or the engineered particle comprises a cargo.

29. The method of claim 28, wherein the cargo is
(a) capable of treating or preventing the muscle disease or disorder;
(b) a morpholino; a peptide-linked morpholino; an antisense oligonucleotide; a PMO, a therapeutic transgene; a polynucleotide encoding a therapeutic polypeptide or peptide; a PPMO; one or more peptides or polypeptides; one or more polynucleotides encoding a CRISPR-Cas protein, a guide RNA, or both; a ribonucleoprotein, wherein the ribonucleoprotein comprises a CRISPR-Cas system molecule; a therapeutic transgene RNA, or other gene modifying or therapeutic RNA and/or protein; or any combination thereof; or
(c) both (a) and (b).

30. The method of claim 27, wherein the muscle disease or disorder is an auto immune disease; a cancer; a muscular dystrophy; a neuro-muscular disease; a sugar or glycogen storage disease; an expanded repeat disease; a dominant negative disease; a cardiomyopathy; a viral disease; a progeroid disease; or any combination thereof.

* * * * *